United States Patent
Steer et al.

(10) Patent No.: US 7,547,534 B2
(45) Date of Patent: Jun. 16, 2009

(54) METHODS FOR MAKING A COMPOSITION TO TREAT A WOOD, A PULP OR A PAPER

(75) Inventors: Brian Steer, San Diego, CA (US); Walter Callen, San Diego, CA (US); Shaun Healey, Carlsbad, CA (US); Geoff Hazlewood, San Diego, CA (US); Di Wu, San Diego, CA (US); David Blum, San Diego, CA (US); Alireza Esteghlalian, La Jolla, CA (US)

(73) Assignee: Verenium Corporation, San Diego, CA (US)

( * ) Notice: Subject to any disclaimer, the term of this patent is extended or adjusted under 35 U.S.C. 154(b) by 286 days.

(21) Appl. No.: 10/517,939

(22) PCT Filed: Jun. 16, 2003

(86) PCT No.: PCT/US03/19153

§ 371 (c)(1),
(2), (4) Date: Jul. 27, 2005

(87) PCT Pub. No.: WO03/106654

PCT Pub. Date: Dec. 24, 2003

(65) Prior Publication Data

US 2006/0003433 A1    Jan. 5, 2006

Related U.S. Application Data

(60) Provisional application No. 60/389,299, filed on Jun. 14, 2002.

(51) Int. Cl.
*C12N 9/24* (2006.01)
*A23L 1/105* (2006.01)
*C12S 3/04* (2006.01)
*C12S 3/08* (2006.01)

(52) U.S. Cl. .................. 435/190; 426/63; 435/277; 435/278

(58) Field of Classification Search ........................ None
See application file for complete search history.

(56) References Cited

U.S. PATENT DOCUMENTS

| | | | |
|---|---|---|---|
| 5,116,746 A | 5/1992 | Bernier et al. | |
| 5,179,021 A | 1/1993 | du Manoir et al. | |
| 5,374,555 A | 12/1994 | Pokora et al. | |
| 5,395,765 A | 3/1995 | Dahlberg et al. | |
| 5,405,769 A | 4/1995 | Campbell et al. | |
| 5,437,992 A | * 8/1995 | Bodie et al. | 435/200 |
| 5,503,709 A | 4/1996 | Burton | |
| 5,591,304 A | 1/1997 | Tolan et al. | |
| 5,618,386 A | 4/1997 | Arbeloa et al. | |
| 5,645,686 A | 7/1997 | Troughton et al. | |
| 5,688,668 A | 11/1997 | Sjoeholm et al. | |
| 5,759,840 A | * 6/1998 | Sung et al. | 435/200 |
| 5,785,811 A | 7/1998 | Pokora et al. | |
| 5,866,526 A | 2/1999 | Olsen et al. | |
| 5,916,795 A | 6/1999 | Fukunaga et al. | |
| 5,935,836 A | * 8/1999 | Vehmaanpera et al. | 435/200 |
| 5,981,253 A | 11/1999 | Outtrup et al. | |
| 6,015,703 A | 1/2000 | White et al. | |
| 6,030,933 A | 2/2000 | Herbots et al. | |
| 6,083,733 A | 7/2000 | Gronberg et al. | |
| 6,140,095 A | 10/2000 | Williams et al. | |
| 6,241,849 B1 | 6/2001 | Franks | |
| 6,346,407 B1 | 2/2002 | De Buyl et al. | |
| 6,426,211 B1 | 7/2002 | de Buyl et al. | |
| 6,555,350 B2 | 4/2003 | Ahring et al. | |
| 2002/0174962 A1 | 11/2002 | Izumi et al. | |
| 2004/0005674 A1 | 1/2004 | Duck et al. | |
| 2004/0013322 A1 | 1/2004 | Taylor | |
| 2004/0077071 A1 | 4/2004 | Tolan et al. | |
| 2004/0112555 A1 | 6/2004 | Tolan et al. | |
| 2005/0150619 A1 | 7/2005 | Tolan et al. | |

FOREIGN PATENT DOCUMENTS

| | | |
|---|---|---|
| EP | 473 545 | * 8/1991 |
| WO | WO-87/06609 | 11/1987 |
| WO | WO-91/05908 | 5/1991 |
| WO | WO-91/11553 | 8/1991 |
| WO | WO-92/03608 | 3/1992 |
| WO | WO-94/04664 | 3/1994 |
| WO | WO-95/27779 | 10/1995 |
| WO | WO-00/29587 | 5/2000 |
| WO | WO-01/18218 | 3/2001 |
| WO | WO-02/052100 | 7/2002 |
| WO | WO-02/057541 | 7/2002 |
| WO | WO-03/074780 | 9/2003 |
| WO | WO-03/093420 | 11/2003 |

OTHER PUBLICATIONS

Chen et al., Can. J. Microbiology (2001) 47:1088-1094.
Henrissat et al., Biochem J. (1993) 293:781-788.
Henrissat et al., Plant Physiology (2000) 124:1515-1519.
International Search Report for PCT/US03/19153, mailed on Jun. 22, 2004, 8 pages.
Joshi et al., J. Mol. Biol. (2000) 299:255-279.
Nielsen et al., Protein Engineering (1997) 10:1-6.
Database UniProt Accession No. Q9KB30, Oct. 1, 2000.
Fushinobu et al., Protein Engineering (1998) 11(12):1121-1128.
Supplementary Partial European Search Report for EP 03 76 04402, mailed on Apr. 12, 2006.

(Continued)

*Primary Examiner*—Rebecca Prouty
(74) *Attorney, Agent, or Firm*—Morrison & Foerster LLP

(57) ABSTRACT

The invention relates to xylanases and to polynucleotides encoding the xylanases. In addition, methods of designing new xylanases and methods of use thereof are also provided. The xylanases have increased activity and stability at increased pH and temperature.

27 Claims, 11 Drawing Sheets

OTHER PUBLICATIONS

Kimura et al., Biosci. Biotechnol. Biochem. (2000) 64(12):2734-2738.
Chen et al., Enzyme and Microbial Technology (1997) 20:39-45.
George et al., Biochem. Biophys. Res. Commun. (2001) 282:48-54.
Supplementary Partial European Search Report for EP 03 76 0440, mailed on Jun. 12, 2006, 7 pages.
Database EMBL [Online], EBI Accession No. EM_PRO:AB063255, Dec. 16, 2001.
Takami et al., GenBank Acession No. AP001514, Jan. 10, 2001.
Written Opinion for PCT/US03/19153, mailed on Jul. 21, 2005, 7 pages.
International Search Report for PCT/US07/04429, mailed on Aug. 15, 2008, 10 pages.
Written Opinion of the International Searching Authority for PCT/US07/04429, mailed on Aug. 15, 2008, 4 pages.

* cited by examiner

Figure 5: Thermal Tolerance of Wild-type Xylanase (SEQ ID NOS:189 and 190) vs. 8x Mutant

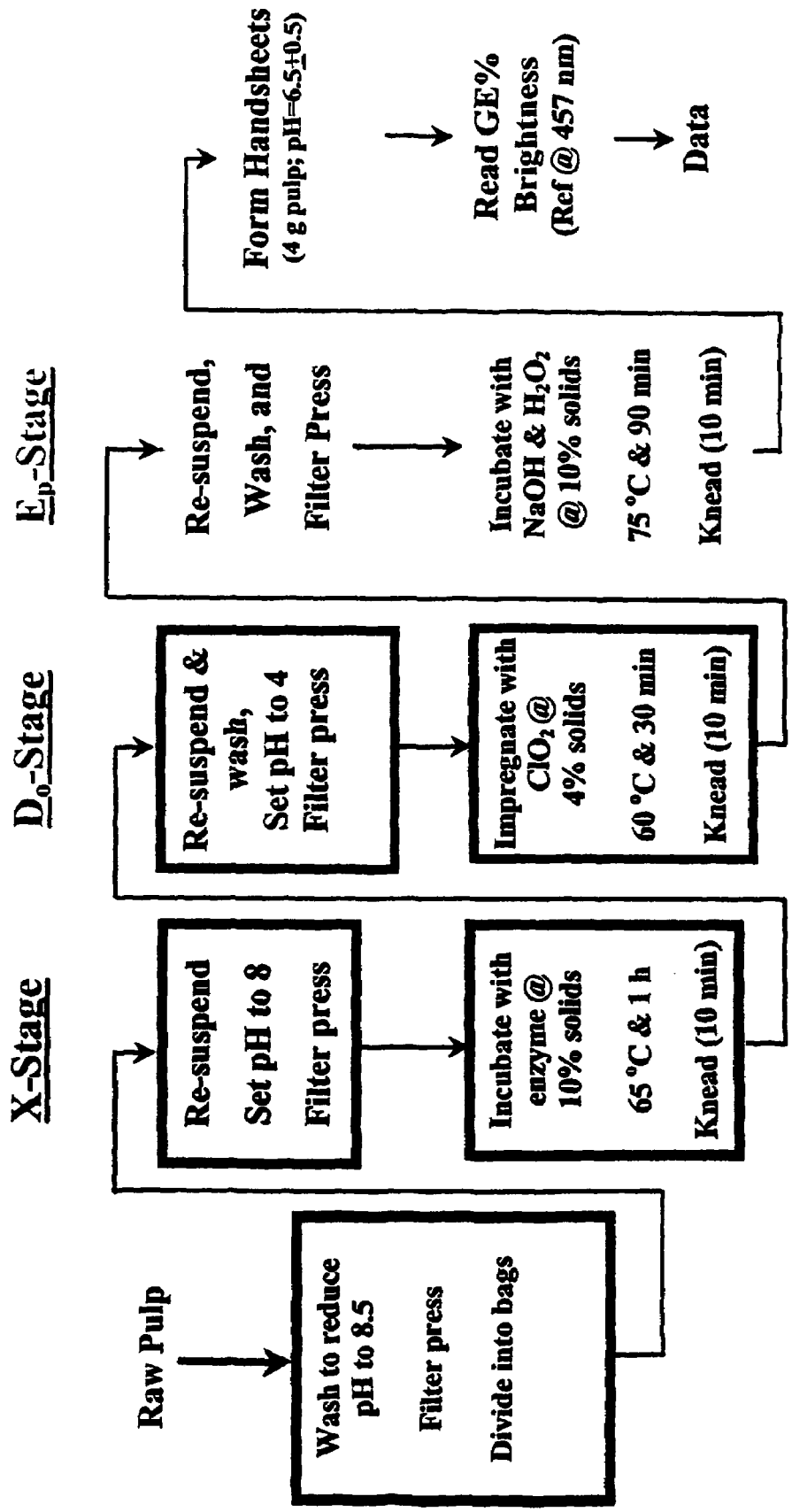
Fig. 11. Diversa Applications Lab Biobleaching Scheme

METHODS FOR MAKING A COMPOSITION TO TREAT A WOOD, A PULP OR A PAPER

RELATED APPLICATIONS

This application is a national phase application claiming benefit of priority under 35 U.S.C. §371 to Patent Convention Treaty (PCT) International Application Ser. No: PCT/US03/19153, filed Jun. 16, 2003 (published as WO 03/106654, on Dec. 24, 2003), which claims benefit of priority to U.S. Provisional Patent Application Ser. No. ("USSN") 60/389,299, filed Jun. 14, 2002. The aforementioned applications are explicitly incorporated herein by reference in their entirety and for all purposes.

SUBMISSION ON COMPACT DISC

The content of the following submission on compact discs is incorporated herein by reference in its entirety: A compact disc copy of the Sequence Listing (CRF) (file name: 564462007901, date recorded: July 27, 2005, size: 1,077,248 bytes); a duplicate compact disc copy of the Sequence Listing (COPY 1) (file name: 564462007901, date recorded: July 27, 2005, size: 1,077,248 bytes); and a duplicate compact disc copy of the Sequence Listing (COPY 2) (file name: 564462007901, date recorded: July 27, 2005, size: 1,077,248 bytes).

FIELD OF THE INVENTION

This invention relates generally to enzymes, polynucleotides encoding the enzymes, the use of such polynucleotides and polypeptides and more specifically to enzymes having xylanase activity, e.g., catalyzing hydrolysis of internal β-1, 4-xylosidic linkages or endo-β-1,4-glucanase linkages.

BACKGROUND

Xylanases (e.g., endo-1,4-beta-xylanase, EC 3.2.1.8) hydrolyze internal β-1,4-xylosidic linkages in xylan to produce smaller molecular weight xylose and xylo-oligomers. Xylans are polysaccharides formed from 1,4-β-glycoside-linked D-xylopyranoses. Xylanases are of considerable commercial value, being used in the food industry, for baking and fruit and vegetable processing, breakdown of agricultural waste, in the manufacture of animal feed and in pulp and paper production. Xylanases are formed by fungi and bacteria.

Arabinoxylanase are major non-starch polysaccharides of cereals representing 2.5-7.1% w/w depending on variety and growth conditions. The physicochemical properties of this polysaccharide are such that it gives rise to viscous solutions or even gels under oxidative conditions. In addition, arabinoxylans have high water-binding capacity and may have a role in protein foam stability. All of these characteristics present problems for several industries including brewing, baking, animal nutrition and paper manufacturing. In brewing applications, the presence of xylan results in wort filterability and haze formation issues. In baking applications (especially for cookies and crackers), these arabinoxylans create sticky doughs that are difficult to machine and reduce biscuit size. In addition, this carbohydrate is implicated in rapid rehydration of the baked product resulting in loss of crispiness and reduced shelf-life. For monogastric animal feed applications with cereal diets, arabinoxylan is a major contributing factor to viscosity of gut contents and thereby adversely affects the digestibility of the feed and animal growth rate. For ruminant animals, these polysaccharides represent substantial components of fiber intake and more complete digestion of arabinoxylans would facilitate higher feed conversion efficiencies.

Xylanases are currently used as additives (dough conditioners) in dough processing for the hydrolysis of water soluble arabinoxylan. In baking applications (especially for cookies and crackers), arabinoxylan creates sticky doughs that are difficult to machine and reduce biscuit size. In addition, this carbohydrate is implicated in rapid rehydration of the baked product resulting in loss of crispiness and reduced shelf-life.

The enhancement of xylan digestion in animal feed may improve the availability and digestibility of valuable carbohydrate and protein feed nutrients. For monogastric animal feed applications with cereal diets, arabinoxylan is a major contributing factor to viscosity of gut contents and thereby adversely affects the digestibility of the feed and animal growth rate. For ruminant animals, these polysaccharides represent substantial components of fiber intake and more complete digestion would facilitate higher feed conversion efficiencies. It is desirable for animal feed xylanases to be active in the animal stomach. This requires a feed enzyme to have high activity at 37° C. and at low pH for monogastrics (pH 2-4) and near neutral pH for ruminants (pH 6.5-7). The enzyme should also possess resistance to animal gut xylanases and stability at the higher temperatures involved in feed pelleting. As such, there is a need in the art for xylanase feed additives for monogastric feed with high specific activity, activity at 35-40° C. and pH 2-4, half life greater than 30 minutes in SGF and a half-life >5 minutes at 85° C. in formulated state. For ruminant feed, there is a need for xylanase feed additives that have a high specific activity, activity at 35-40° C. and pH 6.5-7.0, half life greater than 30 minutes in SRF and stability as a concentrated dry powder.

Xylanases are also used in a number of other applications. For example, xylanases are used in improving the quality and quantity of milk protein production in lactating cows (see, for example, Kung, L., et al, J. Dairy Science 2000 Jan 83:115-122), increasing the amount of soluble saccharides in the stomach and small intestine of pigs (see, for example, van der Meulen, J. et al, Arch. Tierenahr, 2001 54:101-115), improving late egg production efficiency and egg yields in hens (see, for example, Jaroni, D., et al, Poult. Sci., 1999 June 78:841-847). Additionally, xylanases have been shown to be useful in biobleaching and treatment of chemical pulps (see, for example, U.S. Pat. No. 5,202,249), biobleaching and treatment of wood or paper pulps (see, for example, U.S. Pat. Nos. 5,179,021, 5,116,746, 5,407,827, 5,405,769, 5,395,765, 5,369,024, 5,457,045, 5,434,071, 5,498,534, 5,591,304, 5,645,686, 5,725,732, 5,759,840, 5,834,301, 5,871,730 and 6,057,438) in reducing lignin in wood and modifying wood (see, for example, U.S. Pat. Nos. 5,486,468 and 5,770,012) as flour, dough and bread improvers (see, for example, U.S. Pat. Nos. 5,108,765 and 5,306,633) as feed additives and/or supplements, as set forth above (see, for example, U.S. Pat. Nos. 5,432,074, 5,429,828, 5,612,055, 5,720,971, 5,981,233, 5,948,667, 6,099,844, 6,132,727 and 6,132,716), in manufacturing cellulose solutions (see, for example, U.S. Pat. No. 5,760,211). Detergent compositions having xylanase activity are used for fruit, vegetables and/or mud and clay compounds (see, for example, U.S. Pat. No. 5,786,316).

Xylanases are also useful in a method of use and composition of a carbohydrase and/or a xylanase for the manufacture of an agent for the treatments and/or prophylaxis of coccidiosis. The manufactured agent can be in the form of a cereal-based animal feed. (see, for example, U.S. Pat. No.

5,624,678) Additional uses for xylanases include use in the production of water soluble dietary fiber (see, for example, U.S. Pat. No. 5,622,738), in improving the filterability, separation and production of starch (see, for example, U.S. Pat. Nos. 4,960,705 and 5,023,176), in the beverage industry in improving filterability of wort or beer (see, for example, U.S. Pat. No. 4,746,517), in an enzyme composition for promoting the secretion of milk of livestock and improving the quality of the milk (see, for example, U.S. Pat. No. 4,144,354), in reducing viscosity of plant material (see, for example, U.S. Pat. No. 5,874,274), in increasing viscosity or gel strength of food products such as jam, marmalade, jelly, juice, paste, soup, salsa, etc. (see, for example, U.S. Pat. No. 6,036,981). Xylanases may also be used in hydrolysis of hemicellulose for which it is selective, particularly in the presence of cellulose. Additionally, the cellulase rich retentate is suitable for the hydrolysis of cellulose (see, for example, U.S. Pat. No. 4,725,544).

Various uses of xylanases include the production of ethanol (see, for example, PCT Application Nos. WO0043496 and WO8100857), in transformation of a microbe that produces ethanol (see, for example, PCT Application No. WO99/46362), in production of oenological tannins and enzymatic composition (see, for example, PCT Application No. WO0164830), in stimulating the natural defenses of plants (see, for example, PCT Application No. WO0130161), in production of sugars from hemicellulose substrates (see, for example, PCT Application No. WO9203541), in the cleaning of fruit, vegetables, mud or clay containing soils (see, for example, PCT Application No. WO9613568), in cleaning beer filtration membranes (see, for example, PCT Application No. WO9623579), in a method of killing or inhibiting microbial cells (see, for example, PCT Application No. WO9732480) and in determining the characteristics of process waters from wood pulp bleaching by using the ratios of two UV absorption measurements and comparing the spectra (see, for example, PCT Application No. WO9840721).

With regard to xylanases used in the paper and pulp industry, xylanases have been isolated from many sources. In particular, see U.S. Pat. Nos. 6,083,733 and 6,140,095 and 6,346,407. In particular, it is noted that U.S. Pat. No. 6,140,095 addresses alkali-tolerant xylanases. However, it is noted that there remains a need in the art for xylanases to be used in the paper and pulp industry where the enzyme is active in the temperature range of 65° C. to 75° C. and at a pH of approximately 10. Additionally, an enzyme of the invention useful in the paper and pulp industry would decrease the need for bleaching chemicals, such as chlorine dioxide.

The publications discussed herein are provided solely for their disclosure prior to the filing date of the present application. Nothing herein is to be construed as an admission that the invention is not entitled to antedate such disclosure by virtue of prior invention.

SUMMARY OF THE INVENTION

The invention provides isolated or recombinant nucleic acids comprising a nucleic acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention, e.g., SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ BD NO:103, SEQ ID NO:105, SEQ ID NO:107, SEQ ID NO:109, SEQ ID NO:111, SEQ ID NO:113, SEQ ID NO:115, SEQ BD NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:199, SEQ ID NO:161, SEQ D NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ D NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377 or SEQ ID NO:379, over a region of at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2200, 2250, 2300, 2350, 2400, 2450, 2500, or more residues, encodes at least one polypeptide having a xylanase activity, and the sequence identities are determined by analysis with a sequence comparison algorithm or by a visual inspection.

Exemplary nucleic acids of the invention also include isolated or recombinant nucleic acids encoding a polypeptide having a sequence as set forth in SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132; SEQ ID NO:134; SEQ ID NO:136; SEQ ID NO:138; SEQ ID NO:140; SEQ ID NO:142; SEQ ID NO:144; NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ BD NO:232, SEQ ID NO:234, SEQ ID NO:236, SEQ ID NO:238, SEQ ID NO:240, SEQ BD NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ D NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378 or SEQ ID NO:380, and subsequences thereof and variants thereof. In one aspect, the polypeptide has a xylanase activity.

In one aspect, the invention also provides xylanase-encoding nucleic acids with a common novelty in that they are derived from mixed cultures. The invention provides xylanase-encoding nucleic acids isolated from mixed cultures comprising a nucleic acid sequence having at least about 10, 15, 20, 25, 30, 35, 40, 45, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention, e.g., SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ BD NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:15, SEQ B NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:199, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377 or SEQ ID NO:379, over a region of at least about 50, 75, 100, 150, 200, 250, 300, 350, 400, 450, 500, 550, 600, 650, 700, 750, 800, 850, 900, 950, 1000, 1050, 1100, 1150, or more.

In one aspect, the invention also provides xylanase-encoding nucleic acids with a common novelty in that they are derived from an environmental source, e.g., mixed environmental sources, a bacterial source and/or an archaeal source, see Table 3, below. In one aspect, the invention provides xylanase-encoding nucleic acids isolated from an environmental source, e.g., a mixed environmental source, a bacterial source and/or an archaeal source, comprising a nucleic acid sequence having at least about 10, 15, 20, 25, 30, 35, 40, 45, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention over a region of at least about 50, 75, 100, 150, 200, 250, 300, 350, 400, 450, 500, 550, 600, 650, 700, 750, 800, 850, 900, 950, 1000, 1050, 1100, 1150, 1200 or more, residues, wherein the nucleic acid encodes at least one polypeptide having a xylanase activity, and the sequence identities are determined by analysis with a sequence comparison algorithm or by a visual inspection.

In one aspect, the invention also provides xylanase-encoding nucleic acids with a common novelty in that they are derived from a common glycosidase family, e.g., family 5, 6, 8, 10, 11, 26 or 30, as set forth in Table 5, below.

In one aspect, the sequence comparison algorithm is a BLAST version 2.2.2 algorithm where a filtering setting is set to blastall -p blastp -d "nr pataa"-F F, and all other options are set to default.

Another aspect of the invention is an isolated or recombinant nucleic acid including at least 10 consecutive bases of a nucleic acid sequence of the invention, sequences substantially identical thereto, and the sequences complementary thereto.

In one aspect, the xylanase activity comprises catalyzing hydrolysis of internal β-1,4-xylosidic linkages. In one aspect, the xylanase activity comprises an endo-1,4-beta-xylanase activity.

In one aspect, the xylanase activity comprises hydrolyzing a xylan to produce a smaller molecular weight xylose and xylo-oligomer. In one aspect, the xylan comprises an arabinoxylan, such as a water soluble arabinoxylan. The water soluble arabinoxylan can comprise a dough or a bread product.

In one aspect, the xylanase activity comprises hydrolyzing polysaccharides comprising 1,4-β-glycoside-linked D-xylopyranoses. In one aspect, the xylanase activity comprises hydrolyzing hemicelluloses. In one aspect, the xylanase activity comprises hydrolyzing hemicelluloses in a wood or paper pulp or a paper product. In one aspect, the invention provides methods for reducing lignin in a wood or wood product comprising contacting the wood or wood product with a polypeptide of the invention.

In one aspect, the xylanase activity comprises catalyzing hydrolysis of xylans in a beverage or a feed or a food product. The feed or food product can comprise a cereal-based animal feed, a wort or a beer, a milk or a milk product, a fruit or a vegetable. In one aspect, the invention provides a food, feed or beverage or a beverage precursor comprising a polypeptide of the invention. The food can be a dough or a bread product. The beverage or a beverage precursor can be a beer or a wort.

In one aspect, the invention provides methods of dough conditioning comprising contacting a dough or a bread product with at least one polypeptide of the invention under conditions sufficient for conditioning the dough. In one aspect, the invention provides methods of beverage production comprising administration of at least one polypeptide of the invention to a beverage or a beverage precursor under conditions sufficient for decreasing the viscosity of the beverage.

In one aspect, the xylanase activity comprises catalyzing hydrolysis of xylans in a cell, e.g., a plant cell or a microbial cell.

In one aspect, the isolated or recombinant nucleic acid encodes a polypeptide having a xylanase activity that is thermostable. The polypeptide can retain a xylanase activity under conditions comprising a temperature range of between about 37° C. to about 95° C.; between about 55° C. to about 85° C., between about 70° C. to about 95° C., or, between about 90° C. to about 95° C.

In another aspect, the isolated or recombinant nucleic acid encodes a polypeptide having a xylanase activity that is thermotolerant. The polypeptide can retain a xylanase activity after exposure to a temperature in the range from greater than 37° C. to about 95° C. or anywhere in the range from greater than 55° C. to about 85° C. The polypeptide can retain a xylanase activity after exposure to a temperature in the range between about 1° C. to about 5° C., between about 5° C. to about 15° C., between about 15° C. to about 25° C., between about 25° C. to about 37° C., between about 37° C. to about 95° C., between about 55° C. to about 85° C., between about 70° C. to about 75° C., or between about 90° C. to about 95° C., or more. In one aspect, the polypeptide retains a xylanase activity after exposure to a temperature in the range from greater than 90° C. to about 95° C. at pH 4.5.

The invention provides isolated or recombinant nucleic acids comprising a sequence that hybridizes under stringent conditions to a nucleic acid comprising a sequence of the invention, e.g., a sequence as set forth in SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ BD NO:89, SEQ ID NO:91, SEQ BD NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:199, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377 or SEQ ID NO:379, or fragments or subsequences thereof. In one aspect, the nucleic acid encodes a polypeptide having a xylanase activity. The nucleic acid can be at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200 or more residues in length or the full length of the gene or transcript. In one aspect, the stringent conditions include a wash step comprising a wash in 0.2×SSC at a temperature of about 65° C. for about 15 minutes.

The invention provides a nucleic acid probe for identifying a nucleic acid encoding a polypeptide having a xylanase activity, wherein the probe comprises at least about 10, 15, 20, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950, 1000 or more, consecutive bases of a sequence comprising a sequence of the invention, or fragments or subsequences thereof, wherein the probe identifies the nucleic acid by binding or hybridization. The probe can comprise an oligonucleotide comprising at least about 10 to 50, about 20 to 60, about 30 to 70, about 40 to 80, or about 60 to 100 consecutive bases of a sequence comprising a sequence of the invention, or fragments or subsequences thereof.

The invention provides a nucleic acid probe for identifying a nucleic acid encoding a polypeptide having a xylanase activity, wherein the probe comprises a nucleic acid comprising a sequence at least about 10, 15, 20, 30, 40, 50, 60, 70, 80, 90, 100, 150, 200, 250, 300, 350, 400, 450, 500, 550, 600, 650, 700, 750, 800, 850, 900, 950, 1000 or more residues having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to a nucleic acid of the invention, wherein the sequence identities are determined by analysis with a sequence comparison algorithm or by visual inspection.

The probe can comprise an oligonucleotide comprising at least about 10 to 50, about 20 to 60, about 30 to 70, about 40 to 80, or about 60 to 100 consecutive bases of a nucleic acid sequence of the invention, or a subsequence thereof.

The invention provides an amplification primer pair for amplifying a nucleic acid encoding a polypeptide having a xylanase activity, wherein the primer pair is capable of amplifying a nucleic acid comprising a sequence of the invention, or fragments or subsequences thereof. One or each member of the amplification primer sequence pair can comprise an oligonucleotide comprising at least about 10 to 50 consecutive bases of the sequence, or about 12, 13, 14, 15, 16, 17, 18, 19, 20, 21, 22, 23, 24, 25, 26, 27, 28, 29, 30 or more consecutive bases of the sequence.

The invention provides amplification primer pairs, wherein the primer pair comprises a first member having a sequence as set forth by about the first (the 5') 12, 13, 14, 15, 16, 17, 18, 19, 20, 21, 22, 23, 24, 25, 26, 27, 28, 29, 30 or more residues of a nucleic acid of the invention, and a second member having a sequence as set forth by about the first (the 5') 12, 13, 14, 15, 16, 17, 18, 19, 20, 21, 22, 23, 24, 25, 26, 27, 28, 29, 30 or more residues of the complementary strand of the first member.

The invention provides xylanase-encoding nucleic acids generated by amplification, e.g., polymerase chain reaction (PCR), using an amplification primer pair of the invention. The invention provides xylanases generated by amplification, e.g., polymerase chain reaction (PCR), using an amplification primer pair of the invention. The invention provides methods of making a xylanase by amplification, e.g., polymerase chain reaction (PCR), using an amplification primer pair of the invention. In one aspect, the amplification primer pair amplifies a nucleic acid from a library, e.g., a gene library, such as an environmental library.

The invention provides methods of amplifying a nucleic acid encoding a polypeptide having a xylanase activity comprising amplification of a template nucleic acid with an amplification primer sequence pair capable of amplifying a nucleic acid sequence of the invention, or fragments or subsequences thereof.

The invention provides expression cassettes comprising a nucleic acid of the invention or a subsequence thereof. In one aspect, the expression cassette can comprise the nucleic acid that is operably linked to a promoter. The promoter can be a viral, bacterial, mammalian or plant promoter. In one aspect, the plant promoter can be a potato, rice, corn, wheat, tobacco or barley promoter. The promoter can be a constitutive promoter. The constitutive promoter can comprise CaMV35S. In another aspect, the promoter can be an inducible promoter. In one aspect, the promoter can be a tissue-specific promoter or an environmentally regulated or a developmentally regulated promoter. Thus, the promoter can be, e.g., a seed-specific, a leaf-specific, a root-specific, a stem-specific or an abscission-induced promoter. In one aspect, the expression cassette can further comprise a plant or plant virus expression vector.

The invention provides cloning vehicles comprising an expression cassette (e.g., a vector) of the invention or a nucleic acid of the invention. The cloning vehicle can be a viral vector, a plasmid, a phage, a phagemid, a cosmid, a fosmid, a bacteriophage or an artificial chromosome. The viral vector can comprise an adenovirus vector, a retroviral vector or an adeno-associated viral vector. The cloning vehicle can comprise a bacterial artificial chromosome (BAC), a plasmid, a bacteriophage P1-derived vector (PAC), a yeast artificial chromosome (YAC), or a mammalian artificial chromosome (MAC).

The invention provides transformed cell comprising a nucleic acid of the invention or an expression cassette (e.g., a vector) of the invention, or a cloning vehicle of the invention. In one aspect, the transformed cell can be a bacterial cell, a mammalian cell, a fungal cell, a yeast cell, an insect cell or a plant cell. In one aspect, the plant cell can be a cereal, a potato, wheat, rice, corn, tobacco or barley cell.

The invention provides transgenic non-human animals comprising a nucleic acid of the invention or an expression cassette (e.g., a vector) of the invention. In one aspect, the animal is a mouse.

The invention provides transgenic plants comprising a nucleic acid of the invention or an expression cassette (e.g., a vector) of the invention. The transgenic plant can be a cereal plant, a corn plant, a potato plant, a tomato plant, a wheat plant, an oilseed plant, a rapeseed plant, a soybean plant, a rice plant, a barley plant or a tobacco plant.

The invention provides transgenic seeds comprising a nucleic acid of the invention or an expression cassette (e.g., a vector) of the invention. The transgenic seed can be a cereal plant, a corn seed, a wheat kernel, an oilseed, a rapeseed, a soybean seed, a palm kernel, a sunflower seed, a sesame seed, a peanut or a tobacco plant seed.

The invention provides an antisense oligonucleotide comprising a nucleic acid sequence complementary to or capable of hybridizing under stringent conditions to a nucleic acid of the invention. The invention provides methods of inhibiting the translation of a xylanase message in a cell comprising administering to the cell or expressing in the cell an antisense oligonucleotide comprising a nucleic acid sequence complementary to or capable of hybridizing under stringent conditions to a nucleic acid of the invention. In one aspect, the antisense oligonucleotide is between about 10 to 50, about 20 to 60, about 30 to 70, about 40 to 80, or about 60 to 100 bases in length.

The invention provides methods of inhibiting the translation of a xylanase message in a cell comprising administering to the cell or expressing in the cell an antisense oligonucleotide comprising a nucleic acid sequence complementary to or capable of hybridizing under stringent conditions to a nucleic acid of the invention. The invention provides double-stranded inhibitory RNA (RNAi) molecules comprising a subsequence of a sequence of the invention. In one aspect, the RNAi is about 15, 16, 17, 18, 19, 20, 21, 22, 23, 24, 25 or more duplex nucleotides in length. The invention provides methods of inhibiting the expression of a xylanase in a cell comprising administering to the cell or expressing in the cell a double-stranded inhibitory RNA (iRNA), wherein the RNA comprises a subsequence of a sequence of the invention.

The invention provides an isolated or recombinant polypeptide comprising an amino acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary polypeptide or peptide of the invention over a region of at least about 25, 50, 75, 100, 125, 150, 175, 200, 225, 250, 275, 300, 325, 350 or more residues, or over the full length of the polypeptide, and the sequence identities are determined by analysis with a sequence comparison algorithm or by a visual inspection. Exemplary polypeptide or peptide sequences of the invention include SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ D NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132; SEQ ID NO:134; SEQ BD NO:136; SEQ ID NO:138; SEQ ID NO:140; SEQ ID NO:142; SEQ ID NO:144; NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ BD NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ BD NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378 or SEQ ID NO:380, and subsequences thereof and variants thereof. Exemplary polypeptides also include fragments of at least about 10, 15, 20, 25, 30, 35, 40, 45, 50, 75, 100, 150, 200, 250, 300, 350, 400, 450, 500, 550, 600 or more residues in length, or over the full length of an enzyme. Exemplary polypeptide or peptide sequences of the invention include sequence encoded by a nucleic acid of the invention. Exemplary polypeptide or peptide sequences of the invention include polypeptides or peptides specifically bound by an antibody of the invention. In one aspect, a polypeptide of the invention has at least one xylanase activity.

Another aspect of the invention provides an isolated or recombinant polypeptide or peptide including at least 10, 15, 20, 25, 30, 35, 40, 45, 50, 55, 60, 65, 70, 75, 80, 85, 90, 95 or 100 or more consecutive bases of a polypeptide or peptide sequence of the invention, sequences substantially identical thereto, and the sequences complementary thereto. The peptide can be, e.g., an immunogenic fragment, a motif (e.g., a binding site), a signal sequence, a prepro sequence or an active site.

The invention provides isolated or recombinant nucleic acids comprising a sequence encoding a polypeptide having a xylanase activity and a signal sequence, wherein the nucleic acid comprises a sequence of the invention. The signal sequence can be derived from another xylanase or a non-xylanase (a heterologous) enzyme. The invention provides isolated or recombinant nucleic acids comprising a sequence encoding a polypeptide having a xylanase activity, wherein the sequence does not contain a signal sequence and the nucleic acid comprises a sequence of the invention.

In one aspect, the xylanase activity comprises catalyzing hydrolysis of internal β-1,4-xylosidic linkages. In one aspect, the xylanase activity comprises an endo-1,4-beta-xylanase activity. In one aspect, the xylanase activity comprises hydrolyzing a xylan to produce a smaller molecular weight xylose and xylo-oligomer. In one aspect, the xylan comprises an arabinoxylan, such as a water soluble arabinoxylan. The water soluble arabinoxylan can comprise a dough or a bread product.

In one aspect, the xylanase activity comprises hydrolyzing polysaccharides comprising 1,4-β-glycoside-linked D-xylopyranoses. In one aspect, the xylanase activity comprises hydrolyzing hemicelluloses. In one aspect, the xylanase activity comprises hydrolyzing hemicelluloses in a wood or paper pulp or a paper product.

In one aspect, the xylanase activity comprises catalyzing hydrolysis of xylans in a feed or a food product. The feed or food product can comprise a cereal-based animal feed, a wort or a beer, a milk or a milk product, a fruit or a vegetable.

In one aspect, the xylanase activity comprises catalyzing hydrolysis of xylans in a cell, e.g., a plant cell or a microbial cell.

In one aspect, the xylanase activity is thermostable. The polypeptide can retain a xylanase activity under conditions comprising a temperature range of between about 1° C. to about 5° C., between about 5° C. to about 15° C., between about 15° C. to about 25° C., between about 25° C. to about 37° C., between about 37° C. to about 95° C., between about 55° C. to about 85° C., between about 70° C. to about 75° C., or between about 90° C. to about 95° C., or more. In another aspect, the xylanase activity can be thermotolerant. The polypeptide can retain a xylanase activity after exposure to a temperature in the range from greater than 37° C. to about 95° C., or in the range from greater than 55° C. to about 85° C. In one aspect, the polypeptide can retain a xylanase activity after exposure to a temperature in the range from greater than 90° C. to about 95° C. at pH 4.5.

In one aspect, the isolated or recombinant polypeptide can comprise the polypeptide of the invention that lacks a signal sequence. In one aspect, the isolated or recombinant polypeptide can comprise the polypeptide of the invention comprising a heterologous signal sequence, such as a heterologous xylanase or non-xylanase signal sequence.

In one aspect, the invention provides chimeric proteins comprising a first domain comprising a signal sequence of the invention and at least a second domain. The protein can be a fusion protein. The second domain can comprise an enzyme. The enzyme can be a xylanase.

The invention provides chimeric polypeptides comprising at least a first domain comprising signal peptide (SP), a prepro sequence and/or a catalytic domain (CD) of the invention and at least a second domain comprising a heterologous polypeptide or peptide, wherein the heterologous polypeptide or peptide is not naturally associated with the signal peptide (SP), prepro sequence and/or catalytic domain (CD). In one aspect, the heterologous polypeptide or peptide is not a xylanase. The heterologous polypeptide or peptide can be amino terminal to, carboxy terminal to or on both ends of the signal peptide (SP), prepro sequence and/or catalytic domain (CD).

The invention provides isolated or recombinant nucleic acids encoding a chimeric polypeptide, wherein the chimeric polypeptide comprises at least a first domain comprising signal peptide (SP), a prepro domain and/or a catalytic domain (CD) of the invention and at least a second domain comprising a heterologous polypeptide or peptide, wherein the heterologous polypeptide or peptide is not naturally associated with the signal peptide (SP), prepro domain and/or catalytic domain (CD).

The invention provides isolated or recombinant signal sequences (e.g., signal peptides) consisting of a sequence as set forth in residues 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30, 1 to 31, 1 to 32, 1 to 33, 1 to 34, 1 to 35, 1 to 36, 1 to 37, 1 to 38, 1 to 40, 1 to 41, 1 to 42, 1 to 43 or 1 to 44, of a polypeptide of the invention, e.g., SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132; SEQ ID NO:134; SEQ ID NO:136; SEQ ID NO:138; SEQ ID NO:140; SEQ ID NO:142; SEQ ID NO:144; NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ D NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378 or SEQ ID NO:380.

In one aspect, the xylanase activity comprises a specific activity at about 37° C. in the range from about 1 to about 1200 units per milligram of protein, or, about 100 to about 1000 units per milligram of protein. In another aspect, the xylanase activity comprises a specific activity from about 100 to about 1000 units per milligram of protein, or, from about 500 to about 750 units per milligram of protein. Alternatively, the xylanase activity comprises a specific activity at 37° C. in the range from about 1 to about 750 units per milligram of protein, or, from about 500 to about 1200 units per milligram of protein. In one aspect, the xylanase activity comprises a specific activity at 37° C. in the range from about 1 to about 500 units per milligram of protein, or, from about 750 to about 1000 units per milligram of protein. In another aspect, the xylanase activity comprises a specific activity at 37° C. in the range from about 1 to about 250 units per milligram of protein. Alternatively, the xylanase activity comprises a specific activity at 37° C. in the range from about 1 to about 100 units per milligram of protein. In another aspect, the thermotolerance comprises retention of at least half of the specific activity of the xylanase at 37° C. after being heated to the elevated temperature. Alternatively, the thermotolerance can comprise retention of specific activity at 37° C. in the range from about 1 to about 1200 units per milligram of protein, or, from about 500 to about 1000 units per milligram of protein, after being heated to the elevated temperature. In another aspect, the thermotolerance can comprise retention of specific activity at 37° C. in the range from about 1 to about 500 units per milligram of protein after being heated to the elevated temperature.

The invention provides the isolated or recombinant polypeptide of the invention, wherein the polypeptide comprises at least one glycosylation site. In one aspect, glycosylation can be an N-linked glycosylation. In one aspect, the polypeptide can be glycosylated after being expressed in a *P. pastoris* or a *S. pombe*.

In one aspect, the polypeptide can retain a xylanase activity under conditions comprising about pH 6.5, pH 6, pH 5.5, pH 5, pH 4.5 or pH 4. In another aspect, the polypeptide can retain a xylanase activity under conditions comprising about pH 7, pH 7.5 pH 8.0, pH 8.5, pH 9, pH 9.5, pH 10, pH 10.5 or pH 11. In one aspect, the polypeptide can retain a xylanase activity after exposure to conditions comprising about pH 6.5, pH 6, pH 5.5, pH 5, pH 4.5 or pH 4. In another aspect, the polypeptide can retain a xylanase activity after exposure to conditions comprising about pH 7, pH 7.5 pH 8.0, pH 8.5, pH 9, pH 9.5, pH 10, pH 10.5 or pH 11.

The invention provides protein preparations comprising a polypeptide of the invention, wherein the protein preparation comprises a liquid, a solid or a gel.

The invention provides heterodimers comprising a polypeptide of the invention and a second protein or domain. The second member of the heterodimer can be a different phospholipase, a different enzyme or another protein. In one aspect, the second domain can be a polypeptide and the heterodimer can be a fusion protein. In one aspect, the second domain can be an epitope or a tag. In one aspect, the invention provides homodimers comprising a polypeptide of the invention.

The invention provides immobilized polypeptides having a xylanase activity, wherein the polypeptide comprises a polypeptide of the invention, a polypeptide encoded by a nucleic acid of the invention, or a polypeptide comprising a polypeptide of the invention and a second domain. In one aspect, the polypeptide can be immobilized on a cell, a metal, a resin, a polymer, a ceramic, a glass, a micro electrode, a graphitic particle, a bead, a gel, a plate, an array or a capillary tube.

The invention provides arrays comprising an immobilized nucleic acid of the invention. The invention provides arrays comprising an antibody of the invention.

The invention provides isolated or recombinant antibodies that specifically bind to a polypeptide of the invention or to a polypeptide encoded by a nucleic acid of the invention. The antibody can be a monoclonal or a polyclonal antibody. The invention provides hybridomas comprising an antibody of the invention, e.g., an antibody that specifically binds to a polypeptide of the invention or to a polypeptide encoded by a nucleic acid of the invention.

The invention provides method of isolating or identifying a polypeptide having a xylanase activity comprising the steps of: (a) providing an antibody of the invention; (b) providing a sample comprising polypeptides; and (c) contacting the sample of step (b) with the antibody of step (a) under conditions wherein the antibody can specifically bind to the polypeptide, thereby isolating or identifying a polypeptide having a xylanase activity.

The invention provides methods of making an anti-xylanase antibody comprising administering to a non-human animal a nucleic acid of the invention or a polypeptide of the invention or subsequences thereof in an amount sufficient to generate a humoral immune response, thereby making an anti-xylanase antibody. The invention provides methods of making an anti-xylanase immune comprising administering to a non-human animal a nucleic acid of the invention or a polypeptide of the invention or subsequences thereof in an amount sufficient to generate an immune response.

The invention provides methods of producing a recombinant polypeptide comprising the steps of: (a) providing a nucleic acid of the invention operably linked to a promoter; and (b) expressing the nucleic acid of step (a) under conditions that allow expression of the polypeptide, thereby producing a recombinant polypeptide. In one aspect, the method can further comprise transforming a host cell with the nucleic acid of step (a) followed by expressing the nucleic acid of step (a), thereby producing a recombinant polypeptide in a transformed cell.

The invention provides methods for identifying a polypeptide having a xylanase activity comprising the following steps: (a) providing a polypeptide of the invention; or a polypeptide encoded by a nucleic acid of the invention; (b) providing a xylanase substrate; and (c) contacting the polypeptide or a fragment or variant thereof of step (a) with the substrate of step (b) and detecting a decrease in the amount of substrate or an increase in the amount of a reaction product, wherein a decrease in the amount of the substrate or an increase in the amount of the reaction product detects a polypeptide having a xylanase activity.

The invention provides methods for identifying a xylanase substrate comprising the following steps: (a) providing a polypeptide of the invention; or a polypeptide encoded by a nucleic acid of the invention; (b) providing a test substrate; and (c) contacting the polypeptide of step (a) with the test substrate of step (b) and detecting a decrease in the amount of substrate or an increase in the amount of reaction product, wherein a decrease in the amount of the substrate or an increase in the amount of a reaction product identifies the test substrate as a xylanase substrate.

The invention provides methods of determining whether a test compound specifically binds to a polypeptide comprising the following steps: (a) expressing a nucleic acid or a vector comprising the nucleic acid under conditions permissive for translation of the nucleic acid to a polypeptide, wherein the nucleic acid comprises a nucleic acid of the invention, or, providing a polypeptide of the invention; (b) providing a test compound; (c) contacting the polypeptide with the test compound; and (d) determining whether the test compound of step (b) specifically binds to the polypeptide.

The invention provides methods for identifying a modulator of a xylanase activity comprising the following steps: (a) providing a polypeptide of the invention or a polypeptide encoded by a nucleic acid of the invention; (b) providing a test compound; (c) contacting the polypeptide of step (a) with the test compound of step (b) and measuring an activity of the xylanase, wherein a change in the xylanase activity measured in the presence of the test compound compared to the activity in the absence of the test compound provides a determination that the test compound modulates the xylanase activity. In one aspect, the xylanase activity can be measured by providing a xylanase substrate and detecting a decrease in the amount of the substrate or an increase in the amount of a reaction product, or, an increase in the amount of the substrate or a decrease in the amount of a reaction product. A decrease in the amount of the substrate or an increase in the amount of the reaction product with the test compound as compared to the amount of substrate or reaction product without the test compound identifies the test compound as an activator of xylanase activity. An increase in the amount of the substrate or a decrease in the amount of the reaction product with the test compound as compared to the amount of substrate or reaction product without the test compound identifies the test compound as an inhibitor of xylanase activity.

The invention provides computer systems comprising a processor and a data storage device wherein said data storage device has stored thereon a polypeptide sequence or a nucleic acid sequence of the invention (e.g., a polypeptide encoded by a nucleic acid of the invention). In one aspect, the computer system can further comprise a sequence comparison algorithm and a data storage device having at least one reference sequence stored thereon. In another aspect, the sequence comparison algorithm comprises a computer program that indicates polymorphisms. In one aspect, the computer system can further comprise an identifier that identifies one or more features in said sequence. The invention provides computer readable media having stored thereon a polypeptide sequence or a nucleic acid sequence of the invention. The invention provides methods for identifying a feature in a sequence comprising the steps of: (a) reading the sequence using a computer program which identifies one or more features in a sequence, wherein the sequence comprises a polypeptide sequence or a nucleic acid sequence of the invention; and (b) identifying one or more features in the sequence with the computer program. The invention provides methods for comparing a first sequence to a second sequence comprising the steps of: (a) reading the first sequence and the second sequence through use of a computer program which compares sequences, wherein the first sequence comprises a polypeptide sequence or a nucleic acid sequence of the invention; and (b) determining differences between the first sequence and the second sequence with the computer program. The step of determining differences between the first sequence and the second sequence can further comprise the step of identifying polymorphisms. In one aspect, the method can further comprise an identifier that identifies one or more features in a sequence. In another aspect, the method can comprise reading the first sequence using a computer program and identifying one or more features in the sequence.

The invention provides methods for isolating or recovering a nucleic acid encoding a polypeptide having a xylanase activity from an environmental sample comprising the steps of: (a) providing an amplification primer sequence pair for amplifying a nucleic acid encoding a polypeptide having a xylanase activity, wherein the primer pair is capable of amplifying a nucleic acid of the invention; (b) isolating a nucleic acid from the environmental sample or treating the environmental sample such that nucleic acid in the sample is accessible for hybridization to the amplification primer pair; and, (c) combining the nucleic acid of step (b) with the amplification primer pair of step (a) and amplifying nucleic acid from the environmental sample, thereby isolating or recovering a nucleic acid encoding a polypeptide having a xylanase activity from an environmental sample. One or each member of the amplification primer sequence pair can comprise an oligonucleotide comprising at least about 10 to 50 consecutive bases of a sequence of the invention. In one aspect, the amplification primer sequence pair is an amplification pair of the invention.

The invention provides methods for isolating or recovering a nucleic acid encoding a polypeptide having a xylanase activity from an environmental sample comprising the steps of: (a) providing a polynucleotide probe comprising a nucleic acid of the invention or a subsequence thereof; (b) isolating a nucleic acid from the environmental sample or treating the environmental sample such that nucleic acid in the sample is accessible for hybridization to a polynucleotide probe of step (a); (c) combining the isolated nucleic acid or the treated environmental sample of step (b) with the polynucleotide probe of step (a); and (d) isolating a nucleic acid that specifically hybridizes with the polynucleotide probe of step (a), thereby isolating or recovering a nucleic acid encoding a polypeptide having a xylanase activity from an environmental sample. The environmental sample can comprise a water sample, a liquid sample, a soil sample, an air sample or a biological sample. In one aspect, the biological sample can be derived from a bacterial cell, a protozoan cell, an insect cell, a yeast cell, a plant cell, a fungal cell or a mammalian cell.

The invention provides methods of generating a variant of a nucleic acid encoding a polypeptide having a xylanase activity comprising the steps of: (a) providing a template nucleic acid comprising a nucleic acid of the invention; and (b) modifying, deleting or adding one or more nucleotides in the template sequence, or a combination thereof, to generate a variant of the template nucleic acid. In one aspect, the method can further comprise expressing the variant nucleic acid to generate a variant xylanase polypeptide. The modifications, additions or deletions can be introduced by a method comprising error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (e.g., GeneReassembly™, see, e.g., U.S. Pat. No. 6,537,776), gene site saturated mutagenesis (GSSM™), synthetic ligation reassembly (SLR) or a combination thereof. In another aspect, the modifications, additions or deletions are introduced by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

In one aspect, the method can be iteratively repeated until a xylanase having an altered or different activity or an altered or different stability from that of a polypeptide encoded by the template nucleic acid is produced. In one aspect, the variant xylanase polypeptide is thermotolerant, and retains some activity after being exposed to an elevated temperature. In another aspect, the variant xylanase polypeptide has increased glycosylation as compared to the xylanase encoded by a template nucleic acid. Alternatively, the variant xylanase polypeptide has a xylanase activity under a high temperature, wherein the xylanase encoded by the template nucleic acid is not active under the high temperature. In one aspect, the method can be iteratively repeated until a xylanase coding sequence having an altered codon usage from that of the template nucleic acid is produced. In another aspect, the method can be iteratively repeated until a xylanase gene having higher or lower level of message expression or stability from that of the template nucleic acid is produced.

In one aspect, the invention provides isolated or recombinant nucleic acids comprising a sequence as set forth in SEQ ID NO: 189, wherein SEQ ID NO: 189 contains one or more of the following mutations: the nucleotides at positions 22 to 24 are TTC, the nucleotides at positions 31 to 33 are CAC, the nucleotides at positions 34 to 36 are TTG, the nucleotides at positions 49 to 51 are ATA, the nucleotides at positions 31 to 33 are CAT, the nucleotides at positions 67 to 69 are ACG, the nucleotides at positions 178 to 180 are CAC, the nucleotides at positions 190 to 192 are TGT, the nucleotides at positions 190 to 192 are GTA, the nucleotides at positions 190 to 192 are GTT, the nucleotides at positions 193 to 195 are GTG, the nucleotides at positions 202 to 204 are GCT, the nucleotides at positions 235 to 237 are CCA, or the nucleotides at positions 235 to 237 are CCC. In one aspect, the invention provides methods for making a nucleic acid comprising this sequence, wherein the mutations in SEQ ID NO: 189 are obtained by gene site saturated mutagenesis (GSSM™).

In one aspect, the invention provides isolated or recombinant nucleic acids comprising SEQ ID NO: 190, wherein SEQ ID NO: 190 contains one or more of the following mutations: the aspartic acid at amino acid position 8 is phenylalanine, the glutamine at amino acid position 11 is histidine, the asparagine at amino acid position 12 is leucine, the glycine at amino acid position 17 is isoleucine, the threonine at amino acid position 23 is threonine encoded by a codon other than the wild type codon, the glycine at amino acid position 60 is histidine, the proline at amino acid position 64 is cysteine, the proline at amino acid position 64 is valine, the serine at amino acid position 65 is valine, the glycine at amino acid position 68 is isoleucine, the glycine at amino acid position 68 is alanine, or the valine at amino acid position 79 is proline.

The invention provides methods for modifying codons in a nucleic acid encoding a polypeptide having a xylanase activity to increase its expression in a host cell, the method comprising the following steps: (a) providing a nucleic acid of the invention encoding a polypeptide having a xylanase activity; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying codons in a nucleic acid encoding a polypeptide having a xylanase activity; the method comprising the following steps: (a) providing a nucleic acid of the invention; and, (b) identifying a codon in the nucleic acid of step (a) and replacing it with a different codon encoding the same amino acid as the replaced codon, thereby modifying codons in a nucleic acid encoding a xylanase.

The invention provides methods for modifying codons in a nucleic acid encoding a polypeptide having a xylanase activity to increase its expression in a host cell, the method comprising the following steps: (a) providing a nucleic acid of the invention encoding a xylanase polypeptide; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying a codon in a nucleic acid encoding a polypeptide having a xylanase activity to decrease its expression in a host cell, the method comprising the following steps: (a) providing a nucleic acid of the invention; and (b) identifying at least one preferred codon in the nucleic acid of step (a) and replacing it with a non-preferred or less preferred codon encoding the same amino acid as the replaced codon, wherein a preferred codon is a codon over-represented in coding sequences in genes in a host cell and a non-preferred or less preferred codon is a codon under-represented in coding sequences in genes in the host cell, thereby modifying the nucleic acid to decrease its expression in a host cell. In one aspect, the host cell can be a bacterial cell, a fungal cell, an insect cell, a yeast cell, a plant cell or a mammalian cell.

The invention provides methods for producing a library of nucleic acids encoding a plurality of modified xylanase active sites or substrate binding sites, wherein the modified active sites or substrate binding sites are derived from a first nucleic acid comprising a sequence encoding a first active site or a first substrate binding site the method comprising the following steps: (a) providing a first nucleic acid encoding a first active site or first substrate binding site, wherein the first nucleic acid sequence comprises a sequence that hybridizes under stringent conditions to a nucleic acid of the invention, and the nucleic acid encodes a xylanase active site or a xylanase substrate binding site; (b) providing a set of mutagenic oligonucleotides that encode naturally-occurring amino acid variants at a plurality of targeted codons in the first nucleic acid; and, (c) using the set of mutagenic oligonucleotides to generate a set of active site-encoding or substrate binding site-encoding variant nucleic acids encoding a range of amino acid variations at each amino acid codon that was mutagenized, thereby producing a library of nucleic acids encoding a plurality of modified xylanase active sites or substrate binding sites. In one aspect, the method comprises mutagenizing the first nucleic acid of step (a) by a method comprising an optimized directed evolution system, gene site-saturation mutagenesis (GSSM™), synthetic ligation reassembly (SLR), error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (GeneReassembly™, U.S. Pat. No. 6,537,776), gene site saturated mutagenesis (GSSM™), synthetic ligation reassembly (SLR) and a combination thereof. In another aspect, the method comprises mutagenizing the first nucleic acid of step (a) or variants by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

The invention provides methods for making a small molecule comprising the following steps: (a) providing a plurality of biosynthetic enzymes capable of synthesizing or modifying a small molecule, wherein one of the enzymes comprises a xylanase enzyme encoded by a nucleic acid of the invention; (b) providing a substrate for at least one of the enzymes of step (a); and (c) reacting the substrate of step (b) with the enzymes under conditions that facilitate a plurality of biocatalytic reactions to generate a small molecule by a series of biocatalytic reactions. The invention provides methods for modifying a small molecule comprising the following steps: (a) providing a xylanase enzyme, wherein the enzyme comprises a polypeptide of the invention, or, a polypeptide encoded by a nucleic acid of the invention, or a subsequence thereof; (b) providing a small molecule; and (c) reacting the enzyme of step (a) with the small molecule of step (b) under conditions that facilitate an enzymatic reaction catalyzed by the xylanase enzyme, thereby modifying a small molecule by a xylanase enzymatic reaction. In one aspect, the method can comprise a plurality of small molecule substrates for the enzyme of step (a), thereby generating a library of modified small molecules produced by at least one enzymatic reaction catalyzed by the xylanase enzyme. In one aspect, the method can comprise a plurality of additional enzymes under conditions that facilitate a plurality of biocatalytic reactions by the enzymes to form a library of modified small molecules produced by the plurality of enzymatic reactions. In another aspect, the method can further comprise the step of testing the library to determine if a particular modified small molecule that exhibits a desired activity is present within the library. The step of testing the library can further comprise the steps of systematically eliminating all but one of the biocatalytic reactions used to produce a portion of the plurality of the modified small molecules within the library by testing the portion of the modified small molecule for the presence or absence of the particular modified small molecule with a desired activity, and identifying at least one specific biocatalytic reaction that produces the particular modified small molecule of desired activity.

The invention provides methods for determining a functional fragment of a xylanase enzyme comprising the steps of: (a) providing a xylanase enzyme, wherein the enzyme comprises a polypeptide of the invention, or a polypeptide encoded by a nucleic acid of the invention, or a subsequence thereof; and (b) deleting a plurality of amino acid residues from the sequence of step (a) and testing the remaining subsequence for a xylanase activity, thereby determining a functional fragment of a xylanase enzyme. In one aspect, the xylanase activity is measured by providing a xylanase substrate and detecting a decrease in the amount of the substrate or an increase in the amount of a reaction product.

The invention provides methods for whole cell engineering of new or modified phenotypes by using real-time metabolic flux analysis, the method comprising the following steps: (a) making a modified cell by modifying the genetic composition of a cell, wherein the genetic composition is modified by addition to the cell of a nucleic acid of the invention; (b) culturing the modified cell to generate a plurality of modified cells; (c) measuring at least one metabolic parameter of the cell by monitoring the cell culture of step (b) in real time; and, (d) analyzing the data of step (c) to determine if the measured parameter differs from a comparable measurement in an unmodified cell under similar conditions, thereby identifying an engineered phenotype in the cell using real-time metabolic flux analysis. In one aspect, the genetic composition of the cell can be modified by a method comprising deletion of a sequence or modification of a sequence in the cell, or, knocking out the expression of a gene. In one aspect, the method can further comprise selecting a cell comprising a newly engineered phenotype. In another aspect, the method can comprise culturing the selected cell, thereby generating a new cell strain comprising a newly engineered phenotype.

The invention provides methods of increasing thermotolerance or thermostability of a xylanase polypeptide, the method comprising glycosylating a xylanase polypeptide, wherein the polypeptide comprises at least thirty contiguous amino acids of a polypeptide of the invention; or a polypeptide encoded by a nucleic acid sequence of the invention, thereby increasing the thermotolerance or thermostability of the xylanase polypeptide. In one aspect, the xylanase specific activity can be thermostable or thermotolerant at a temperature in the range from greater than about 37° C. to about 95° C.

The invention provides methods for overexpressing a recombinant xylanase polypeptide in a cell comprising expressing a vector comprising a nucleic acid comprising a nucleic acid of the invention or a nucleic acid sequence of the invention, wherein the sequence identities are determined by analysis with a sequence comparison algorithm or by visual inspection, wherein overexpression is effected by use of a high activity promoter, a dicistronic vector or by gene amplification of the vector.

The invention provides methods of making a transgenic plant comprising the following steps: (a) introducing a heterologous nucleic acid sequence into the cell, wherein the heterologous nucleic sequence comprises a nucleic acid sequence of the invention, thereby producing a transformed plant cell; and (b) producing a transgenic plant from the transformed cell. In one aspect, the step (a) can further comprise introducing the heterologous nucleic acid sequence by electroporation or microinjection of plant cell protoplasts. In another aspect, the step (a) can further comprise introducing the heterologous nucleic acid sequence directly to plant tissue by DNA particle bombardment. Alternatively, the step (a) can further comprise introducing the heterologous nucleic acid sequence into the plant cell DNA using an *Agrobacterium tumefaciens* host. In one aspect, the plant cell can be a potato, corn, rice, wheat, tobacco, or barley cell.

The invention provides methods of expressing a heterologous nucleic acid sequence in a plant cell comprising the following steps: (a) transforming the plant cell with a heterologous nucleic acid sequence operably linked to a promoter, wherein the heterologous nucleic sequence comprises a nucleic acid of the invention; (b) growing the plant under conditions wherein the heterologous nucleic acids sequence is expressed in the plant cell. The invention provides methods of expressing a heterologous nucleic acid sequence in a plant cell comprising the following steps: (a) transforming the plant cell with a heterologous nucleic acid sequence operably linked to a promoter, wherein the heterologous nucleic sequence comprises a sequence of the invention; (b) growing the plant under conditions wherein the heterologous nucleic acids sequence is expressed in the plant cell.

The invention provides methods for hydrolyzing, breaking up or disrupting a xylan-comprising composition comprising the following steps: (a) providing a polypeptide of the invention having a xylanase activity, or a polypeptide encoded by a nucleic acid of the invention; (b) providing a composition comprising a xylan; and (c) contacting the polypeptide of step (a) with the composition of step (b) under conditions wherein the xylanase hydrolyzes, breaks up or disrupts the xylan-comprising composition. In one aspect, the composition comprises a plant cell, a bacterial cell, a yeast cell, an insect cell, or an animal cell. Thus, the composition can comprise any plant or plant part, any xylan-containing food or feed, a waste product and the like. The invention provides methods for liquefying or removing a xylan-comprising composition comprising the following steps: (a) providing a polypeptide of the invention having a xylanase activity, or a polypeptide encoded by a nucleic acid of the invention; (b) providing a composition comprising a xylan; and (c) contacting the polypeptide of step (a) with the composition of step (b) under conditions wherein the xylanase removes, softens or liquefies the xylan-comprising composition.

The invention provides detergent compositions comprising a polypeptide of the invention, or a polypeptide encoded by a nucleic acid of the invention, wherein the polypeptide has a xylanase activity. The xylanase can be a nonsurface-active xylanase or a surface-active xylanase. The xylanase can be formulated in a non-aqueous liquid composition, a cast solid, a granular form, a particulate form, a compressed tablet, a gel form, a paste or a slurry form. The invention provides methods for washing an object comprising the following steps: (a) providing a composition comprising a polypeptide of the invention having a xylanase activity, or a polypeptide encoded by a nucleic acid of the invention; (b) providing an object; and (c) contacting the polypeptide of step (a) and the object of step (b) under conditions wherein the composition can wash the object.

The invention provides textiles or fabrics, including, e.g., threads, comprising a polypeptide of the invention, or a polypeptide encoded by a nucleic acid of the invention. In one aspect, the textiles or fabrics comprise xylan-containing fibers. The invention provides methods for treating a textile or fabric (e.g., removing a stain from a composition) comprising the following steps: (a) providing a composition comprising a polypeptide of the invention having a xylanase activity, or a polypeptide encoded by a nucleic acid of the invention; (b) providing a textile or fabric comprising a xylan; and (c) contacting the polypeptide of step (a) and the composition of step (b) under conditions wherein the xylanase can treat the textile or fabric (e.g., remove the stain). The invention provides methods for improving the finish of a fabric comprising the following steps: (a) providing a composition comprising a polypeptide of the invention having a xylanase activity, or a polypeptide encoded by a nucleic acid of the invention; (b) providing a fabric; and (c) contacting the polypeptide of step (a) and the fabric of step (b) under conditions wherein the polypeptide can treat the fabric thereby improving the finish of the fabric. In one aspect, the fabric is a wool or a silk.

The invention provides feeds or foods comprising a polypeptide of the invention, or a polypeptide encoded by a nucleic acid of the invention. The invention provides methods for hydrolyzing xylans in a feed or a food prior to consumption by an animal comprising the following steps: (a) obtaining a feed material comprising a xylanase of the invention, or a xylanase encoded by a nucleic acid of the invention; and (b) adding the polypeptide of step (a) to the feed or food material in an amount sufficient for a sufficient time period to cause hydrolysis of the xylan and formation of a treated food or feed, thereby hydrolyzing the xylans in the food or the feed prior to consumption by the animal. In one aspect, the invention provides methods for hydrolyzing xylans in a feed or a food after consumption by an animal comprising the following steps: (a) obtaining a feed material comprising a xylanase of the invention, or a xylanase encoded by a nucleic acid of the invention; (b) adding the polypeptide of step (a) to the feed or food material; and (c) administering the feed or food material to the animal, wherein after consumption, the xylanase causes hydrolysis of xylans in the feed or food in the digestive tract of the animal. The food or the feed can be, e.g., a cereal, a grain, a corn and the like.

The invention provides food or nutritional supplements for an animal comprising a polypeptide of the invention, e.g., a polypeptide encoded by the nucleic acid of the invention. In one aspect, the polypeptide in the food or nutritional supplement can be glycosylated. The invention provides edible enzyme delivery matrices comprising a polypeptide of the invention, e.g., a polypeptide encoded by the nucleic acid of the invention. In one aspect, the delivery matrix comprises a pellet. In one aspect, the polypeptide can be glycosylated. In one aspect, the xylanase activity is thermotolerant. In another aspect, the xylanase activity is thermostable.

The invention provides a food, a feed or a nutritional supplement comprising a polypeptide of the invention. The invention provides methods for utilizing a xylanase as a nutritional supplement in an animal diet, the method comprising: preparing a nutritional supplement containing a xylanase enzyme comprising at least thirty contiguous amino acids of a polypeptide of the invention; and administering the nutritional supplement to an animal to increase utilization of a xylan contained in a feed or a food ingested by the animal. The animal can be a human, a ruminant or a monogastric animal. The xylanase enzyme can be prepared by expression of a polynucleotide encoding the xylanase in an organism selected from the group consisting of a bacterium, a yeast, a plant, an insect, a fungus and an animal. The organism can be selected from the group consisting of an *S. pombe, S. cerevisiae, Pichia pastoris, Pseudomonas* sp., *E. coli, Streptomyces* sp., *Bacillus* sp. and *Lactobacillus* sp.

The invention provides edible enzyme delivery matrix comprising a thermostable recombinant xylanase enzyme, e.g., a polypeptide of the invention. The invention provides methods for delivering a xylanase supplement to an animal, the method comprising: preparing an edible enzyme delivery matrix in the form of pellets comprising a granulate edible carrier and a thermostable recombinant xylanase enzyme, wherein the pellets readily disperse the xylanase enzyme contained therein into aqueous media, and administering the edible enzyme delivery matrix to the animal. The recombinant xylanase enzyme can comprise a polypeptide of the invention. The granulate edible carrier can comprise a carrier selected from the group consisting of a grain germ, a grain germ that is spent of oil, a hay, an alfalfa, a timothy, a soy hull, a sunflower seed meal and a wheat midd. The edible carrier can comprise grain germ that is spent of oil. The xylanase enzyme can be glycosylated to provide thermostability at pelletizing conditions. The delivery matrix can be formed by pelletizing a mixture comprising a grain germ and a xylanase. The pelletizing conditions can include application of steam. The pelletizing conditions can comprise application of a temperature in excess of about 80° C. for about 5 minutes and the enzyme retains a specific activity of at least 350 to about 900 units per milligram of enzyme.

The invention provides methods for improving texture and flavor of a dairy product comprising the following steps: (a) providing a polypeptide of the invention having a xylanase activity, or a xylanase encoded by a nucleic acid of the invention; (b) providing a dairy product; and (c) contacting the polypeptide of step (a) and the dairy product of step (b) under conditions wherein the xylanase can improve the texture or flavor of the dairy product. In one aspect, the dairy product comprises a cheese or a yogurt. The invention provides dairy products comprising a xylanase of the invention, or is encoded by a nucleic acid of the invention.

The invention provides methods for improving the extraction of oil from an oil-rich plant material comprising the following steps: (a) providing a polypeptide of the invention having a xylanase activity, or a xylanase encoded by a nucleic acid of the invention; (b) providing an oil-rich plant material; and (c) contacting the polypeptide of step (a) and the oil-rich plant material. In one aspect, the oil-rich plant material comprises an oil-rich seed. The oil can be a soybean oil, an olive oil, a rapeseed (canola) oil or a sunflower oil.

The invention provides methods for preparing a fruit or vegetable juice, syrup, puree or extract comprising the following steps: (a) providing a polypeptide of the invention having a xylanase activity, or a xylanase encoded by a nucleic acid of the invention; (b) providing a composition or a liquid comprising a fruit or vegetable material; and (c) contacting the polypeptide of step (a) and the composition, thereby preparing the fruit or vegetable juice, syrup, puree or extract.

The invention provides papers or paper products or paper pulp comprising a xylanase of the invention, or a polypeptide encoded by a nucleic acid of the invention. The invention provides methods for treating a paper or a paper or wood pulp comprising the following steps: (a) providing a polypeptide of the invention having a xylanase activity, or a xylanase encoded by a nucleic acid of the invention; (b) providing a composition comprising a paper or a paper or wood pulp; and (c) contacting the polypeptide of step (a) and the composition of step (b) under conditions wherein the xylanase can treat the paper or paper or wood pulp. In one aspect, the pharmaceutical composition acts as a digestive aid or an anti-microbial (e.g., against *Salmonella*). In one aspect, the treatment is prophylactic. In one aspect, the invention provides oral care products comprising a polypeptide of the invention having a xylanase activity, or a xylanase encoded by a nucleic acid of the invention. The oral care product can comprise a toothpaste, a dental cream, a gel or a tooth powder, an odontic, a mouth wash, a pre- or post brushing rinse formulation, a chewing gum, a lozenge or a candy. The invention provides contact lens cleaning compositions comprising a polypeptide of the invention having a xylanase activity, or a xylanase encoded by a nucleic acid of the invention.

In one aspect, the invention provides methods for eliminating or protecting animals from a microorganism comprising a xylan comprising administering a polypeptide of the invention. The microorganism can be a bacterium comprising a xylan, e.g., *Salmonella*.

The invention provides an isolated nucleic acid having a sequence as set forth in SEQ ID NO.:189 and variants thereof having at least 50% sequence identity to SEQ ID NO.:189 and encoding polypeptides having xylanase activity. In one aspect, the polypeptide has a xylanase activity, e.g., a thermostable xylanase activity.

The invention provides isolated or recombinant nucleic acids comprising SEQ ID NO:189, wherein SEQ ID NO:189 comprises one or more or all of the following sequence variations: the nucleotides at positions 22 to 24 are TTC, the nucleotides at positions 22 to 24 are TTT, the nucleotides at positions 31 to 33 are CAC, the nucleotides at positions 31 to 33 are CAT, the nucleotides at positions 34 to 36 are TTG, the nucleotides at positions 34 to 36 are TTA, the nucleotides at positions 34 to 36 are CTC, the nucleotides at positions 34 to 36 are CTT, the nucleotides at positions 34 to 36 are CTA, the nucleotides at positions 34 to 36 are CTG, the nucleotides at positions 49 to 51 are ATA, the nucleotides at positions 49 to 51 are ATT, the nucleotides at positions 49 to 51 are ATC, the nucleotides at positions 178 to 180 are CAC, the nucleotides at positions 178 to 180 are CAT, the nucleotides at positions 190 to 192 are TGT, the nucleotides at positions 190 to 192 are TGC, the nucleotides at positions 190 to 192 are GTA, the nucleotides at positions 190 to 192 are GTT, the nucleotides at positions 190 to 192 are GTC, the nucleotides at positions 190 to 192 are GTG, the nucleotides at positions 193 to 195 are GTG, the nucleotides at positions 193 to 195 are GTC, the nucleotides at positions 193 to 195 are GTA, the nucleotides at positions 193 to 195 are GTT, the nucleotides at positions 202 to 204 are ATA, the nucleotides at positions 202 to 204 are ATT, the nucleotides at positions 202 to 204 are ATC, the nucleotides at positions 202 to 204 are GCT, the nucleotides at positions 202 to 204 are GCG, the nucleotides at positions 202 to 204 are GCC, the nucleotides at positions 202 to 204 are GCA, the nucleotides at positions 235 to 237 are CCA, the nucleotides at positions 235 to 237 are CCC, or the nucleotides at positions 235 to 237 are CCG.

The invention provides isolated or recombinant polypeptides comprising an amino acid sequence comprising SEQ ID NO:190, wherein SEQ ID NO:190 comprises one or more or all of the following sequence variations: the aspartic acid at amino acid position 8 is phenylalanine, the glutamine at amino acid position 11 is histidine, the asparagine at amino acid position 12 is leucine, the glycine at amino acid position 17 is isoleucine, the threonine at amino acid position 23 is threonine encoded by a codon other than the wild type codon, the glycine at amino acid position 60 is histidine, the proline at amino acid position 64 is cysteine, the proline at amino acid position 64 is valine, the serine at amino acid position 65 is valine, the glycine at amino acid position 68 is isoleucine, the glycine at amino acid position 68 is alanine, or the serine at amino acid position 79 is proline. In one aspect, the polypeptide has a xylanase activity, e.g., a thermostable xylanase activity.

The invention provides isolated or recombinant nucleic acids comprising SEQ ID NO: 189, wherein SEQ ID NO: 189 comprises one or more or all sequence variations set forth in Table 1 or Table 2. The invention provides isolated or recombinant polypeptides encoded by nucleic acids comprising SEQ ID NO: 189, wherein SEQ ID NO:189 comprises one or more or all sequence variations set forth in Table 1 or Table 2. In one aspect, the polypeptide has a xylanase activity, e.g., a thermostable xylanase activity.

The invention provides isolated or recombinant nucleic acids comprising SEQ D NO:379, wherein SEQ ID NO:379 comprises one or more or all of the following sequence variations: the nucleotides at positions 22 to 24 are TTC, the nucleotides at positions 31 to 33 are CAC, the nucleotides at positions 49 to 51 are ATA, the nucleotides at positions 178 to 180 are CAC, the nucleotides at positions 193 to 195 are GTG, the nucleotides at positions 202 to 204 are GCT.

The invention provides isolated or recombinant polypeptides comprising SEQ ID NO:380, wherein SEQ ID NO:380 comprises one or more or all of the following sequence variations: D8F, Q11H, G17I, G60H, S65V and/or G68A. In one aspect, the polypeptide has a xylanase activity, e.g., a thermostable xylanase activity.

The isolated or recombinant nucleic acids of the invention are also referred to as "Group A nucleic acid sequences". The invention provides an isolated nucleic acid including at least 10 consecutive bases of a sequence as set forth in Group A nucleic acid sequences, sequences substantially identical thereto and the sequences complementary thereto.

The isolated or recombinant polypeptides of the invention, which include functional fragments of the exemplary sequences of the invention, are also referred to as "Group B amino acid sequences". Another aspect of the invention is an isolated or recombinant nucleic acid encoding a polypeptide having at least 10 consecutive amino acids of a sequence as set forth in Group B amino acid sequences and sequences substantially identical thereto. In yet another aspect, the invention provides a purified polypeptide having a sequence as set forth in Group B amino acid sequences and sequences substantially identical thereto. Another aspect of the invention is an isolated or purified antibody that specifically binds to a polypeptide having a sequence as set forth in Group B amino acid sequences and sequences substantially identical thereto.

Another aspect of the invention is an isolated or purified antibody or binding fragment thereof, which specifically binds to a polypeptide having at least 10 consecutive amino acids of one of the polypeptides of Group B amino acid sequences and sequences substantially identical thereto.

Another aspect of the invention is a method of making a polypeptide having a sequence as set forth in Group B amino acid sequences and sequences substantially identical thereto. The method includes introducing a nucleic acid encoding the polypeptide into a host cell, wherein the nucleic acid is operably linked to a promoter and culturing the host cell under conditions that allow expression of the nucleic acid. Another aspect of the invention is a method of making a polypeptide having at least 10 amino acids of a sequence as set forth in Group B amino acid sequences and sequences substantially identical thereto. The method includes introducing a nucleic acid encoding the polypeptide into a host cell, wherein the nucleic acid is operably linked to a promoter and culturing the host cell under conditions that allow expression of the nucleic acid, thereby producing the polypeptide.

Another aspect of the invention is a method of generating a variant including obtaining a nucleic acid having a sequence as set forth in Group A nucleic acid sequences, sequences substantially identical thereto, sequences complementary to the sequences of Group A nucleic acid sequences, fragments comprising at least 30 consecutive nucleotides of the foregoing sequences and changing one or more nucleotides in the sequence to another nucleotide, deleting one or more nucleotides in the sequence, or adding one or more nucleotides to the sequence.

Another aspect of the invention is a computer readable medium having stored thereon a sequence as set forth in Group A nucleic acid sequences and sequences substantially identical thereto, or a polypeptide sequence as set forth in Group B amino acid sequences and sequences substantially identical thereto.

Another aspect of the invention is a computer system including a processor and a data storage device wherein the data storage device has stored thereon a sequence as set forth in Group A nucleic acid sequences and sequences substantially identical thereto, or a polypeptide having a sequence as set forth in Group B amino acid sequences and sequences substantially identical thereto.

Another aspect of the invention is a method for comparing a first sequence to a reference sequence wherein the first sequence is a nucleic acid having a sequence as set forth in Group A nucleic acid sequences and sequences substantially identical thereto, or a polypeptide code of Group B amino acid sequences and sequences substantially identical thereto. The method includes reading the first sequence and the reference sequence through use of a computer program that compares sequences; and determining differences between the first sequence and the reference sequence with the computer program.

Another aspect of the invention is a method for identifying a feature in a sequence as set forth in Group A nucleic acid sequences and sequences substantially identical thereto, or a polypeptide having a sequence as set forth in Group B amino acid sequences and sequences substantially identical thereto, including reading the sequence through the use of a computer program which identifies features in sequences; and identifying features in the sequence with the computer program.

Yet another aspect of the invention is a method of catalyzing the breakdown of xylan or a derivative thereof, comprising the step of contacting a sample containing xylan or the derivative thereof with a polypeptide of Group B amino acid sequences and sequences substantially identical thereto under conditions which facilitate the breakdown of the xylan.

Another aspect of the invention is an assay for identifying fragments or variants of Group B amino acid sequences and sequences substantially identical thereto, which retain the enzymatic function of the polypeptides of Group B amino acid sequences and sequences substantially identical thereto. The assay includes contacting the polypeptide of Group B amino acid sequences, sequences substantially identical thereto, or polypeptide fragment or variant with a substrate molecule under conditions which allow the polypeptide fragment or variant to function and detecting either a decrease in the level of substrate or an increase in the level of the specific reaction product of the reaction between the polypeptide and substrate thereby identifying a fragment or variant of such sequences.

Another aspect of the invention is a nucleic acid probe of an oligonucleotide from about 10 to 50 nucleotides in length and having a segment of at least 10 contiguous nucleotides that is at least 50% complementary to a nucleic acid target region of a nucleic acid sequence selected from the group consisting of Group A nucleic acid sequences; and which hybridizes to the nucleic acid target region under moderate to highly stringent conditions to form a detectable target:probe duplex.

Another aspect of the invention is a polynucleotide probe for isolation or identification of xylanase genes having a sequence which is the same as, or fully complementary to at least a fragment of one of Group A nucleic acid sequences.

In still another aspect, the invention provides a protein preparation comprising a polypeptide having an amino acid sequence selected from Group B amino acid sequences and sequences substantially identical thereto wherein the protein preparation is a liquid.

Still another aspect of the invention provides a protein preparation comprising a polypeptide having an amino acid sequence selected from Group B amino acid sequences and sequences substantially identical thereto wherein the polypeptide is a solid.

Yet another aspect of the invention provides a method for modifying small molecules, comprising the step of mixing at least one polypeptide encoded by a polynucleotide selected from Group A nucleic acid sequences, sequences substantially identical thereto and the sequences complementary thereto with at least one small molecule, to produce at least one modified small molecule via at least one biocatalytic reaction, where the at least one polypeptide has xylanase activity.

Another aspect of the invention is a cloning vector of a sequence that encodes a polypeptide having xylanase activity, said sequence being selected from Group A nucleic acid sequences, sequences substantially identical thereto and the sequences complementary thereto.

Another aspect of the invention is a host cell comprising a sequence that encodes a polypeptide having xylanase activity, said sequence being selected from Group A nucleic acid sequences, sequences substantially identical thereto and the sequences complementary thereto.

In yet another aspect, the invention provides an expression vector capable of replicating in a host cell comprising a polynucleotide having a sequence selected Group A nucleic acid sequences, sequences substantially identical thereto, sequences complementary thereto and isolated nucleic acids that hybridize to nucleic acids having any of the foregoing sequences under conditions of low, moderate and high stringency.

In another aspect, the invention provides a method of dough conditioning comprising contacting dough with at least one polypeptide of Group B amino acid sequences and sequences substantially identical thereto under conditions sufficient for conditioning the dough.

Another aspect of the invention is a method of beverage production comprising administration of at least one polypeptide of Group B amino acid sequences and sequences substantially identical thereto under conditions sufficient for decreasing the viscosity of wort or beer.

The xylanases of the invention are used to break down the high molecular weight arabinoxylans in animal feed. Adding the xylanases of the invention stimulates growth rates by improving digestibility, which also improves the quality of the animal litter. Xylanase functions through the gastrointestinal tract to reduce intestinal viscosity and increase diffusion of pancreatic enzymes. Additionally, the xylanases of the invention may be used in the treatment of endosperm cell walls of feed grains and vegetable proteins. In one aspect of the invention, the novel xylanases of the invention are administered to an animal in order to increase the utilization of the xylan in the food. This activity of the xylanases of the invention may be used to break down insoluble cell wall material, liberating nutrients in the cell walls, which then become available to the animal. It also changes hemicellulose to nutritive sugars so that nutrients formerly trapped within the cell walls are released. Xylanase also produces compounds that may be a nutritive source for the ruminal microflora.

Another aspect of the invention provides a method for utilizing xylanase as a nutritional supplement in the diets of animals, comprising preparation of a nutritional supplement containing a recombinant xylanase enzyme comprising at least thirty contiguous amino acids of Group B amino acid sequences and sequences substantially identical thereto and administering the nutritional supplement to an animal to increase the utilization of xylan contained in food ingested by the animal.

In another aspect of the invention, a method for delivering a xylanase supplement to an animal is provided, where the method comprises preparing an edible enzyme delivery matrix in the form of pellets comprising a granulate edible carrier and a thermostable recombinant xylanase enzyme, wherein the particles readily disperse the xylanase enzyme contained therein into aqueous media, and administering the edible enzyme delivery matrix to the animal. The granulate edible carrier may comprise a carrier selected from the group consisting of grain germ that is spent of oil, hay, alfalfa, timothy, soy hull, sunflower seed meal and wheat midd. The xylanase enzyme may have an amino acid sequence as set forth in Group B amino acid sequences and sequences substantially identical thereto.

In another aspect, the invention provides an isolated nucleic acid comprising a sequence that encodes a polypeptide having xylanase activity, wherein the sequence is selected from Group A nucleic acid sequences, sequences substantially identical thereto and the sequences complementary thereto, wherein the sequence contains a signal sequence. The invention also provides an isolated nucleic acid comprising a sequence that encodes a polypeptide having xylanase activity, wherein the sequence is selected from Group A nucleic acid sequences, sequences substantially identical thereto and the sequences complementary thereto, wherein the sequence contains a signal sequence from another xylanase. Additionally, the invention provides an isolated nucleic acid comprising a sequence that encodes a polypeptide having xylanase activity, wherein the sequence is selected from Group A nucleic acid sequences, sequences substantially identical thereto and the sequences complementary thereto wherein the sequence does not contain a signal sequence.

Still another aspect of the invention provides an isolated nucleic acid that is a mutation of SEQ ID NO: 189. Yet another aspect provides an amino acid sequence that is a mutation of SEQ ID NO: 190.

The details of one or more embodiments of the invention are set forth in the accompanying drawings and the description below. Other features, objects, and advantages of the invention will be apparent from the description and drawings, and from the claims.

All publications, patents, patent applications, GenBank sequences and ATCC deposits, cited herein are hereby expressly incorporated by reference for all purposes.

BRIEF DESCRIPTION OF THE DRAWINGS

The following drawings are illustrative of aspects of the invention and are not meant to limit the scope of the invention as encompassed by the claims.

The patent or application file contains at least one drawing executed in color. Copies of this patent or patent application publication with color drawing(s) will be provided by the Office upon request and payment of the necessary fee.

FIG. 11 is a schematic flow diagram of an exemplary routine screening protocol to determine whether a xylanase of the invention is useful in pretreating paper pulp, as described in detail in Example 6, below.

Like reference symbols in the various drawings indicate like elements.

DETAILED DESCRIPTION OF THE INVENTION

Figure 1:
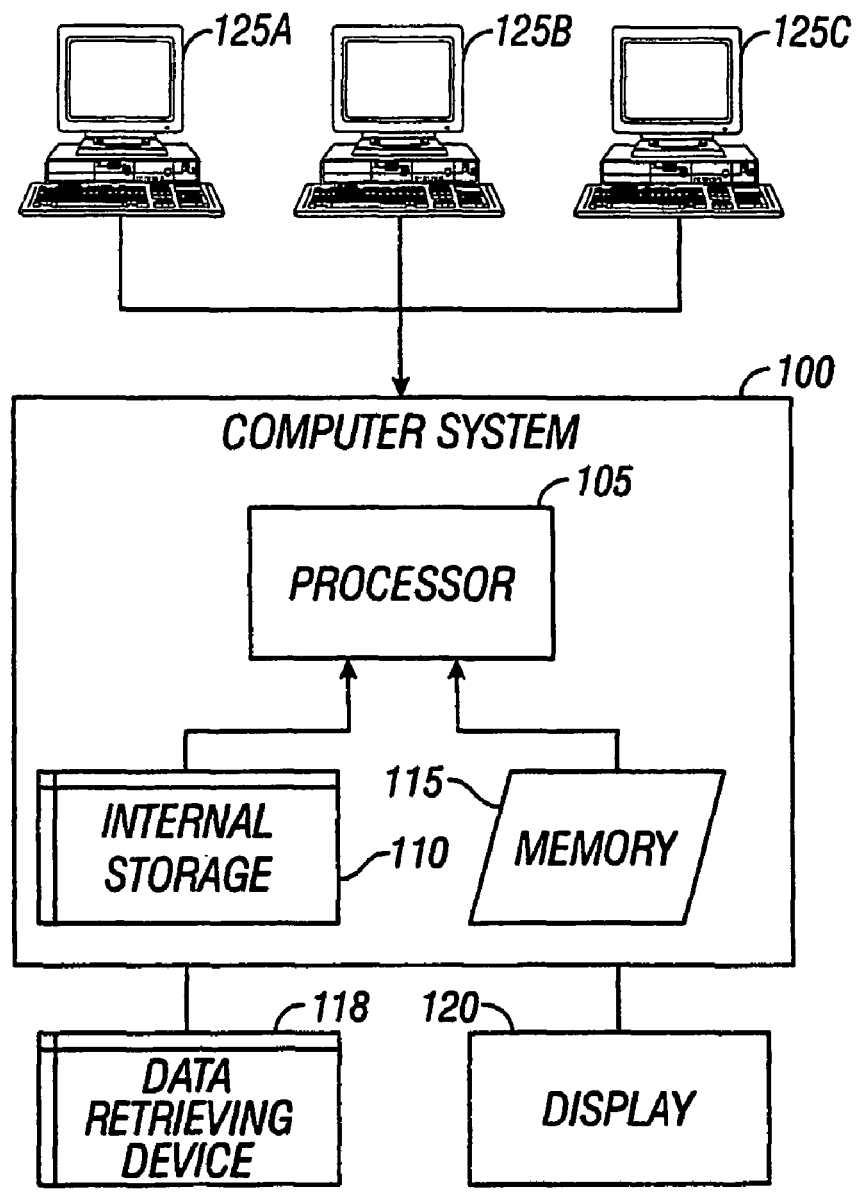
FIG. 1 is a block diagram of a computer system.

The present invention relates to xylanases and polynucleotides encoding them and methods of making and using them. Xylanase activity of the polypeptides of the invention encompasses enzymes having hydrolase activity, for example, enzymes capable of hydrolyzing glycosidic linkages present in xylan, e.g., catalyzing hydrolysis of internal β-1,4-xylosidic linkages. The xylanases of the invention can be used to make and/or process foods, feeds, nutritional supplements, textiles, detergents and the like. The xylanases of the invention can be used in pharmaceutical compositions and dietary aids. Xylanases of the invention are particularly useful in baking, animal feed, beverage and paper processes.

Definitions

The term "antibody" includes a peptide or polypeptide derived from, modeled after or substantially encoded by an immunoglobulin gene or immunoglobulin genes, or fragments thereof, capable of specifically binding an antigen or epitope, see, e.g. Fundamental Immunology, Third Edition, W. E. Paul, ed., Raven Press, N.Y. (1993); Wilson (1994) J. Immunol. Methods 175:267-273; Yarmush (1992) J. Biochem. Biophys. Methods 25:85-97. The term antibody includes antigen-binding portions, i.e., "antigen binding sites," (e.g., fragments, subsequences, complementarity determining regions (CDRs)) that retain capacity to bind antigen, including (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) Nature 341:544-546), which consists of a VH domain; and (vi) an isolated complementarity determining region (CDR). Single chain antibodies are also included by reference in the term "antibody."

The terms "array" or "microarray" or "biochip" or "chip" as used herein is a plurality of target elements, each target element comprising a defined amount of one or more polypeptides (including antibodies) or nucleic acids immobilized onto a defined area of a substrate surface, as discussed in further detail, below.

As used herein, the terms "computer," "computer program" and "processor" are used in their broadest general contexts and incorporate all such devices, as described in detail, below. A "coding sequence of" or a "sequence encodes" a particular polypeptide or protein, is a nucleic acid sequence which is transcribed and translated into a polypeptide or protein when placed under the control of appropriate regulatory sequences.

The phrases "nucleic acid" or "nucleic acid sequence" as used herein refer to an oligonucleotide, nucleotide, polynucleotide, or to a fragment of any of these, to DNA or RNA of genomic or synthetic origin which may be single-stranded or double-stranded and may represent a sense or antisense strand, to peptide nucleic acid (PNA), or to any DNA-like or RNA-like material, natural or synthetic in origin. The phrases "nucleic acid" or "nucleic acid sequence" includes oligonucleotide, nucleotide, polynucleotide, or to a fragment of any of these, to DNA or RNA (e.g., mRNA, rRNA, tRNA, iRNA) of genomic or synthetic origin which may be single-stranded or double-stranded and may represent a sense or antisense strand, to peptide nucleic acid (PNA), or to any DNA-like or RNA-like material, natural or synthetic in origin, including, e.g., iRNA, ribonucleoproteins (e.g., e.g., double stranded iRNAs, e.g., iRNPs). The term encompasses nucleic acids, i.e., oligonucleotides, containing known analogues of natural nucleotides. The term also encompasses nucleic-acid-like structures with synthetic backbones, see e.g., Mata (1997) Toxicol. Appl. Pharmacol. 144:189-197; Strauss-Soukup (1997) Biochemistry 36:8692-8698; Samstag (1996) Antisense Nucleic Acid Drug Dev 6:153-156. "Oligonucleotide" includes either a single stranded polydeoxynucleotide or two complementary polydeoxynucleotide strands that may be chemically synthesized. Such synthetic oligonucleotides have no 5' phosphate and thus will not ligate to another oligonucleotide without adding a phosphate with an ATP in the presence of a kinase. A synthetic oligonucleotide can ligate to a fragment that has not been dephosphorylated.

A "coding sequence of" or a "nucleotide sequence encoding" a particular polypeptide or protein, is a nucleic acid sequence which is transcribed and translated into a polypeptide or protein when placed under the control of appropriate regulatory sequences.

The term "gene" means the segment of DNA involved in producing a polypeptide chain; it includes regions preceding and following the coding region (leader and trailer) as well as, where applicable, intervening sequences (introns) between individual coding segments (exons). "Operably linked" as used herein refers to a functional relationship between two or more nucleic acid (e.g., DNA) segments. Typically, it refers to the functional relationship of transcriptional regulatory sequence to a transcribed sequence. For example, a promoter is operably linked to a coding sequence, such as a nucleic acid of the invention, if it stimulates or modulates the transcription of the coding sequence in an appropriate host cell or other expression system. Generally, promoter transcriptional regulatory sequences that are operably linked to a transcribed sequence are physically contiguous to the transcribed sequence, i.e., they are cis-acting. However, some transcriptional regulatory sequences, such as enhancers, need not be physically contiguous or located in close proximity to the coding sequences whose transcription they enhance.

The term "expression cassette" as used herein refers to a nucleotide sequence which is capable of affecting expression of a structural gene (i.e., a protein coding sequence, such as a xylanase of the invention) in a host compatible with such sequences. Expression cassettes include at least a promoter operably linked with the polypeptide coding sequence; and, optionally, with other sequences, e.g., transcription termination signals. Additional factors necessary or helpful in effecting expression may also be used, e.g., enhancers. Thus, expression cassettes also include plasmids, expression vectors, recombinant viruses, any form of recombinant "naked DNA" vector, and the like. A "vector" comprises a nucleic acid that can infect, transfect, transiently or permanently transduce a cell. It will be recognized that a vector can be a naked nucleic acid, or a nucleic acid complexed with protein or lipid. The vector optionally comprises viral or bacterial nucleic acids and/or proteins, and/or membranes (e.g., a cell membrane, a viral lipid envelope, etc.). Vectors include, but are not limited to replicons (e.g., RNA replicons, bacteriophages) to which fragments of DNA may be attached and become replicated. Vectors thus include, but are not limited to RNA, autonomous self-replicating circular or linear DNA or RNA (e.g., plasmids, viruses, and the like, see, e.g., U.S. Pat. No. 5,217,879), and include both the expression and non-expression plasmids. Where a recombinant microorganism or cell culture is described as hosting an "expression vector" this includes both extra-chromosomal circular and linear DNA and DNA that has been incorporated into the host chromosome(s). Where a vector is being maintained by a host cell, the vector may either be stably replicated by the cells during mitosis as an autonomous structure, or is incorporated within the host's genome.

As used herein, the term "promoter" includes all sequences capable of driving transcription of a coding sequence in a cell, e.g., a plant cell. Thus, promoters used in the constructs of the invention include cis-acting transcriptional control elements and regulatory sequences that are involved in regulating or modulating the timing and/or rate of transcription of a gene. For example, a promoter can be a cis-acting transcriptional control element, including an enhancer, a promoter, a transcription terminator, an origin of replication, a chromosomal integration sequence, 5' and 3' untranslated regions, or an intronic sequence, which are involved in transcriptional regulation. These cis-acting sequences typically interact with proteins or other biomolecules to carry out (turn on/off, regulate, modulate, etc.) transcription. "Constitutive" promoters are those that drive expression continuously under most environmental conditions and states of development or cell differentiation. "Inducible" or "regulatable" promoters direct expression of the nucleic acid of the invention under the influence of environmental conditions or developmental conditions. Examples of environmental conditions that may affect transcription by inducible promoters include anaerobic conditions, elevated temperature, drought, or the presence of light.

"Tissue-specific" promoters are transcriptional control elements that are only active in particular cells or tissues or organs, e.g., in plants or animals. Tissue-specific regulation may be achieved by certain intrinsic factors that ensure that genes encoding proteins specific to a given tissue are expressed. Such factors are known to exist in mammals and plants so as to allow for specific tissues to develop.

The term "plant" includes whole plants, plant parts (e.g., leaves, stems, flowers, roots, etc.), plant protoplasts, seeds and plant cells and progeny of same. The class of plants which can be used in the method of the invention is generally as broad as the class of higher plants amenable to transformation techniques, including angiosperms (monocotyledonous and dicotyledonous plants), as well as gymnosperms. It includes plants of a variety of ploidy levels, including polyploid, diploid, haploid and hemizygous states. As used herein, the term "transgenic plant" includes plants or plant cells into which a heterologous nucleic acid sequence has been inserted, e.g., the nucleic acids and various recombinant constructs (e.g., expression cassettes) of the invention.

"Plasmids" can be commercially available, publicly available on an unrestricted basis, or can be constructed from available plasmids in accord with published procedures. Equivalent plasmids to those described herein are known in the art and will be apparent to the ordinarily skilled artisan.

"Amino acid" or "amino acid sequence" as used herein refer to an oligopeptide, peptide, polypeptide, or protein sequence, or to a fragment, portion, or subunit of any of these and to naturally occurring or synthetic molecules.

"Amino acid" or "amino acid sequence" include an oligopeptide, peptide, polypeptide, or protein sequence, or to a fragment, portion, or subunit of any of these, and to naturally occurring or synthetic molecules. The term "polypeptide" as used herein, refers to amino acids joined to each other by peptide bonds or modified peptide bonds, i.e., peptide isosteres and may contain modified amino acids other than the 20 gene-encoded amino acids. The polypeptides may be modified by either natural processes, such as post-translational processing, or by chemical modification techniques that are well known in the art. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphytidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, xylan hydrolase processing, phosphorylation, prenylation, racemization, selenoylation, sulfation and transfer-RNA mediated addition of amino acids to protein such as arginylation. (See Creighton, T. E., *Proteins—Structure and Molecular Properties 2nd Ed.*, W.H. Freeman and Company, New York (1993); *Posttranslational Covalent Modification of Proteins*, B. C. Johnson, Ed., Academic Press, New York, pp. 1-12 (1983)). The peptides and polypeptides of the invention also include all "mimetic" and "peptidomimetic" forms, as described in further detail, below.

As used herein, the term "isolated" means that the material is removed from its original environment (e.g., the natural environment if it is naturally occurring). For example, a naturally-occurring polynucleotide or polypeptide present in a living animal is not isolated, but the same polynucleotide or polypeptide, separated from some or all of the coexisting materials in the natural system, is isolated. Such polynucleotides could be part of a vector and/or such polynucleotides or polypeptides could be part of a composition and still be isolated in that such vector or composition is not part of its natural environment. As used herein, the term "purified" does not require absolute purity; rather, it is intended as a relative definition. Individual nucleic acids obtained from a library have been conventionally purified to electrophoretic homogeneity. The sequences obtained from these clones could not be obtained directly either from the library or from total human DNA. The purified nucleic acids of the invention have been purified from the remainder of the genomic DNA in the organism by at least $10^4$-$10^6$ fold. However, the term "purified" also includes nucleic acids that have been purified from the remainder of the genomic DNA or from other sequences in a library or other environment by at least one order of magnitude, typically two or three orders and more typically four or five orders of magnitude.

As used herein, the term "recombinant" means that the nucleic acid is adjacent to a "backbone" nucleic acid to which it is not adjacent in its natural environment. Additionally, to be "enriched" the nucleic acids will represent 5% or more of the number of nucleic acid inserts in a population of nucleic acid backbone molecules. Backbone molecules according to the invention include nucleic acids such as expression vectors, self-replicating nucleic acids, viruses, integrating nucleic acids and other vectors or nucleic acids used to maintain or manipulate a nucleic acid insert of interest. Typically, the enriched nucleic acids represent 15% or more of the number of nucleic acid inserts in the population of recombinant backbone molecules. More typically, the enriched nucleic acids represent 50% or more of the number of nucleic acid inserts in the population of recombinant backbone molecules. In a one aspect, the enriched nucleic acids represent 90% or more of the number of nucleic acid inserts in the population of recombinant backbone molecules.

"Recombinant" polypeptides or proteins refer to polypeptides or proteins produced by recombinant DNA techniques; i.e., produced from cells transformed by an exogenous DNA construct encoding the desired polypeptide or protein. "Synthetic" polypeptides or protein are those prepared by chemical synthesis. Solid-phase chemical peptide synthesis methods can also be used to synthesize the polypeptide or fragments of the invention. Such method have been known in the art since the early 1960's (Merrifield, R. B., *J. Am. Chem. Soc.*, 85:2149-2154, 1963) (See also Stewart, J. M. and Young, J. D., *Solid Phase Peptide Synthesis, 2nd Ed.*, Pierce Chemical Co., Rockford, M., pp. 11-12)) and have recently been employed in commercially available laboratory peptide design and synthesis kits (Cambridge Research Biochemicals). Such commercially available laboratory kits have generally utilized the teachings of H. M. Geysen et al, *Proc. Natl. Acad. Sci., USA,* 81:3998 (1984) and provide for synthesizing peptides upon the tips of a multitude of "rods" or "pins" all of which are connected to a single plate. When such a system is utilized, a plate of rods or pins is inverted and inserted into a second plate of corresponding wells or reservoirs, which contain solutions for attaching or anchoring an appropriate amino acid to the pin's or rod's tips. By repeating such a process step, i.e., inverting and inserting the rod's and pin's tips into appropriate solutions, amino acids are built into desired peptides. In addition, a number of available FMOC peptide synthesis systems are available. For example, assembly of a polypeptide or fragment can be carried out on a solid support using an Applied Biosystems, Inc. Model 431A automated peptide synthesizer. Such equipment provides ready access to the peptides of the invention, either by direct synthesis or by synthesis of a series of fragments that can be coupled using other known techniques.

A promoter sequence is "operably linked to" a coding sequence when RNA polymerase which initiates transcription at the promoter will transcribe the coding sequence into mRNA.

"Plasmids" are designated by a lower case "p" preceded and/or followed by capital letters and/or numbers. The starting plasmids herein are either commercially available, publicly available on an unrestricted basis, or can be constructed from available plasmids in accord with published procedures. In addition, equivalent plasmids to those described herein are known in the art and will be apparent to the ordinarily skilled artisan.

"Digestion" of DNA refers to catalytic cleavage of the DNA with a restriction enzyme that acts only at certain sequences in the DNA. The various restriction enzymes used herein are commercially available and their reaction conditions, cofactors and other requirements were used as would be known to the ordinarily skilled artisan. For analytical purposes, typically 1 μg of plasmid or DNA fragment is used with about 2 units of enzyme in about 20 μl of buffer solution. For the purpose of isolating DNA fragments for plasmid construction, typically 5 to 50 μg of DNA are digested with 20 to 250 units of enzyme in a larger volume. Appropriate buffers and substrate amounts for particular restriction enzymes are specified by the manufacturer. Incubation times of about 1 hour at 37° C. are ordinarily used, but may vary in accordance with the supplier's instructions. After digestion, gel electrophoresis may be performed to isolate the desired fragment.

The phrase "substantially identical" in the context of two nucleic acids or polypeptides, refers to two or more sequences that have, e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more nucleotide or amino acid residue (sequence) identity, when compared and aligned for maximum correspondence, as measured using one of the known sequence comparison algorithms or by visual inspection. Typically, the substantial identity exists over a region of at least about 100 residues and most commonly the sequences are substantially identical over at least about 150-200 residues. In some aspects, the sequences are substantially identical over the entire length of the coding regions.

Additionally a "substantially identical" amino acid sequence is a sequence that differs from a reference sequence by one or more conservative or non-conservative amino acid substitutions, deletions, or insertions, particularly when such a substitution occurs at a site that is not the active site of the molecule and provided that the polypeptide essentially retains its functional properties. A conservative amino acid substitution, for example, substitutes one amino acid for another of the same class (e.g., substitution of one hydrophobic amino acid, such as isoleucine, valine, leucine, or methionine, for another, or substitution of one polar amino acid for another, such as substitution of arginine for lysine, glutamic acid for aspartic acid or glutamine for asparagine). One or more amino acids can be deleted, for example, from a xylanase polypeptide, resulting in modification of the structure of the polypeptide, without significantly altering its biological activity. For example, amino- or carboxyl-terminal amino acids that are not required for xylanase biological activity can be removed. Modified polypeptide sequences of the invention can be assayed for xylanase biological activity by any number of methods, including contacting the modified polypeptide sequence with a xylanase substrate and determining whether the modified polypeptide decreases the amount of specific substrate in the assay or increases the bioproducts of the enzymatic reaction of a functional xylanase polypeptide with the substrate.

"Fragments" as used herein are a portion of a naturally occurring protein which can exist in at least two different conformations. Fragments can have the same or substantially the same amino acid sequence as the naturally occurring protein. "Substantially the same" means that an amino acid sequence is largely, but not entirely, the same, but retains at least one functional activity of the sequence to which it is related. In general two amino acid sequences are "substantially the same" or "substantially homologous" if they are at least about 85% identical. Fragments which have different three dimensional structures as the naturally occurring protein are also included. An example of this, is a "pro-form" molecule, such as a low activity proprotein that can be modified by cleavage to produce a mature enzyme with significantly higher activity.

"Hybridization" refers to the process by which a nucleic acid strand joins with a complementary strand through base pairing. Hybridization reactions can be sensitive and selective so that a particular sequence of interest can be identified even in samples in which it is present at low concentrations. Suitably stringent conditions can be defined by, for example, the concentrations of salt or formamide in the prehybridization and hybridization solutions, or by the hybridization temperature and are well known in the art. In particular, stringency can be increased by reducing the concentration of salt, increasing the concentration of formamide, or raising the hybridization temperature. In alternative aspects, nucleic acids of the invention are defined by their ability to hybridize under various stringency conditions (e.g., high, medium, and low), as set forth herein.

For example, hybridization under high stringency conditions could occur in about 50% formamide at about 37° C. to 42° C. Hybridization could occur under reduced stringency conditions in about 35% to 25% formamide at about 30° C. to 35° C. In particular, hybridization could occur under high stringency conditions at 42° C. in 50% formamide, 5× SSPE, 0.3% SDS and 200 n/ml sheared and denatured salmon sperm DNA. Hybridization could occur under reduced stringency conditions as described above, but in 35% formamide at a reduced temperature of 35° C. The temperature range corresponding to a particular level of stringency can be further narrowed by calculating the purine to pyrimidine ratio of the nucleic acid of interest and adjusting the temperature accordingly. Variations on the above ranges and conditions are well known in the art.

The term "variant" refers to polynucleotides or polypeptides of the invention modified at one or more base pairs, codons, introns, exons, or amino acid residues (respectively) yet still retain the biological activity of a xylanase of the invention. Variants can be produced by any number of means included methods such as, for example, error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (e.g., GeneReassembly™, see, e.g., U.S. Pat. No. 6,537,776), GSSM™ and any combination thereof.

Table 1 and Table 2 list variants obtained by mutating SEQ ID NO:189 (encoding SEQ ID NO:190) by GSSM™. The invention provides nucleic acids having one or more, or all, of the sequences as set forth in Tables 1 and 2, i.e., nucleic acids having sequences that are variants of SEQ ID NO:189, where the variations are set forth in Table 1 and Table 2, and the polypeptides that are encoded by these variants.

Figure 5:
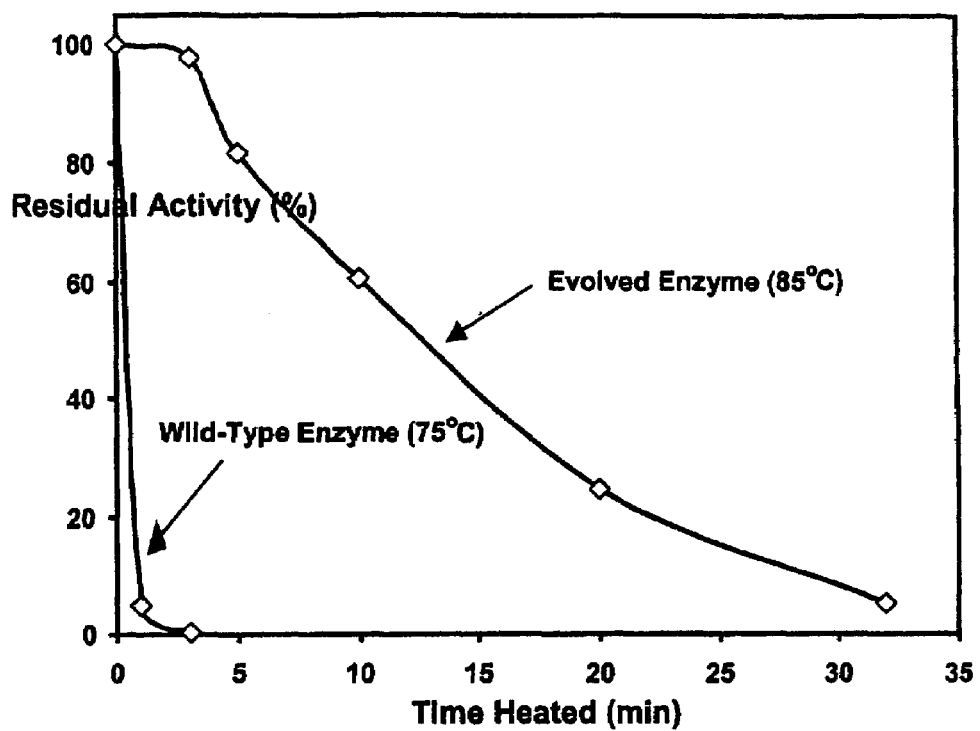
FIG. 5 is a graph comparing activity of the wild type sequence (SEQ ID NOS: 189 and 190) to the 8× mutant (SEQ ID NOS:375, 376), a combination of mutants D, F, H, I, S, V, X and AA in Table 1.

These GSSM™ variants (set forth in Tables 1 and 2) were tested for thermal tolerance (see Examples, below). Mutants D, F, G, H, I, J, K, S, T, U, V, W, X, Y, Z, AA, DD and EE were found to have the highest thermal tolerance among the mutants in Table 1. Mutants may also be combined to form a larger mutant. For example, mutants D, F, H, I, S, V, X and AA of Table 1 were combined to form a larger mutant termed "8x" with a sequence as set forth in SEQ ID NO:375 (polypeptide encoding nucleic acid) and SEQ ID NO:376 (amino acid sequence). FIG. 5 is a graph comparing the activity of the wild type sequence (SEQ ID NOS: 189 and 190) to the 8× mutant (SEQ ID NOS: 259 and 260). In comparing the wild type and the 8× mutant, it was discovered that the optimal temperature for both was 65° C. and that the optimal pH for both was 5.5. The wild type sequence was found to maintain its stability for less than 1 minute at 65° C., while the 8× mutant (SEQ ID NOS:375, 376) was found to maintain its stability for more than 10 minutes at 85° C. The substrate used was AZO-AZO-xylan. In one aspect, the 8× mutant (SEQ ID NOS:375, 376) was evolved by GSSM™. In another aspect, the wild type is a GSSM™ parent for thermal tolerance evolution.

TABLE 1

| Mutant | Mutation | Wild type Seq | GSSM ™ Seq |
|--------|----------|---------------|------------|
| A | A2F | GCC | TTT |
| B | A2D | GCC | GAC |
| C | A5H | GCT | CAC |
| D | D8F | GAC | TTC |
| E | Q11L | CAA | CTC |
| F | Q11H | CAA | CAC |
| G | N12L | AAT | TTG |
| H | N12L | AAT | TTG |
| I | G17I | GGT | ATA |

TABLE 1-continued

| Mutant | Mutation | Wild type Seq | GSSM ™ Seq |
|---|---|---|---|
| J | Q11H,T23T | CAA, ACC | CAT, ACG |
| K | Q11H | CAA | CAT |
| L | S26P | TCT | CCG |
| M | S26P | TCT | CCA |
| N | S35F | TCA | TTT |
| O | No Change | GTT | GTA |
| P | A51P | GCA | CCG |
| Q | A51P | GCA | CCG |
| R | G60R | GGA | CGC |
| S | G60H | GGA | CAC |
| T | G60H | GGA | CAC |
| U | P64C | CCG | TGT |
| V | P64V | CCG | GTA |
| W | P64V | CCG | GTT |
| X | S65V | TCC | GTG |
| Y | Q11H | CAA | CAT |
| Z | G68I | GGA | ATA |
| AA | G68A | GGA | GCT |
| BB | A71G | GGT | GGA |
| CC | No Change | AAT | AAC |
| DD | S79P | TCA | CCA |
| EE | S79P | TCA | CCC |
| FF | T95S | ACT | TCT |
| GG | Y98P | TAT | CCG |
| HH | T114S | ACT | AGC |
| II | No Change | AAC | AAC |
| JJ | No Change | AGG | AGA |
| KK | I142L | ATT | CTG |
| LL | S151I | AGC | ATC |
| MM | S138T,S151A | TCG, AGC | ACG, GCG |
| NN | K158R | AAG | CGG |
| OO | K160V,V172I | AAA,GTA | GTT,ATA |

The codon variants as set forth in Table 2 that produced variants (of SEQ ID NO:189) with the best variation or "improvement" over "Wild type" (SEQ ID NO:189) in thermal tolerance are highlighted. As noted above, the invention provides nucleic acids, and the polypeptides that encode them, comprising one, several or all or the variations set forth in Table 2 and Table 1.

TABLE 2

| Mutation | Wild type Sequence | GSSM ™ Sequence | Other codons also coding for same changed amino acid |
|---|---|---|---|
| A2F | GCC | TTT | TTC |
| A2D | GCC | GAC | GAT |
| A5H | GCT | CAC | CAT |
|  | GAC |  | TTT |
| Q11L | CAA | CTC | TTA, TTG, CTT, CTA, CTG |
|  | CAA |  ,  |  |
|  | AAT |  | TTA, CTC, CTT, CTA, CTG |
|  | GGT |  | ATT, ATC |
| T23T | ACC | ACG | ACT, ACC, ACA |
| S26P | TCT | CCG, CCA | CCC |
| S35F | TCA | TTT | TTC |
| A51P | GCA | CCG | CCC, CCA |
| G60R | GGA | CGC | CGT, CGA, CGG, AGA, AGG |
|  | GGA |  | CAT |
|  | CCG |  | TGC |
|  | CCG |  ,  | GTC, GTG |
|  | TCC |  | GTC, GTA, GTT |
|  | GGA |  | ATT, ATC |
|  | GGA |  | GCG, GCC, GCA |
| A71G | GCT | GGA | GGT, GGC, GGG |
|  | TCA |  ,  | CCG |
| T95S | ACT | TCT | TCC, TCA, TCG, AGT, AGC |
| Y98P | TAT | CCG | CCC, CCA |
| T114S | ACT | AGC | TCC, TCA, TCG, AGT, TCT |
| I142L | ATT | CTG | TTA, CTC, CTT, CTA, TTG |
| S151I | AGC | ATC | ATT, ATA |
| S138T | TCG | ACG | ACT, ACC, ACA |
| S151A | AGC | GCG | GCT, GCC, GCA |
| K158R | AAG | CGG | CGT, CGA, CGC, AGA, AGG |
| K160V | AAA | GTT | GTC, GTA, GTG |
| V172I | GTA | ATA | ATT, ATC |

In one aspect the amino acid sequence of an amino acid sequence (SEQ ID NO: 208) of Group B amino acid sequences is modified by a single amino acid mutation. In a specific aspect, that mutation is an asparagine to aspartic acid mutation. The resulting amino acid sequence and corresponding nucleic acid sequence are set forth as SEQ ID NO:252 and SEQ ID NO:251, respectively. Single amino acid mutations with an improvement in the pH optimum of the enzyme, such as the mutation of SEQ ID NO:208, have been shown in the art with respect to xylanases. (See, for example, Joshi, M., Sidhu, G., Pot, I., Brayer, G., Withers, S., McIntosh, L., *J. Mol. Bio.* 299, 255-279 (2000).) It is also noted that in such single amino acid mutations, portions of the sequences may be removed in the subcloning process. For example, SEQ ID NO:207 and SEQ ID NO:251 differ in only one nucleotide, over the area that the sequences align. However, it is noted that a 78 nucleotide area at the N-terminus of SEQ ID NO:207 was removed from the N-terminus of SEQ ID NO:251 in the subcloning. Additionally, the first three nucleotides in SEQ ID NO:251 were changed to ATG and then the point mutation was made at the sixth nucleotide in SEQ ID NO:251.

The term "saturation mutagenesis", "gene site saturated mutagenesis" or "GSSM™" includes a method that uses degenerate oligonucleotide primers to introduce point mutations into a polynucleotide, as described in detail, below.

The term "optimized directed evolution system" or "optimized directed evolution" includes a method for reassembling fragments of related nucleic acid sequences, e.g., related genes, and explained in detail, below.

The term "synthetic ligation reassembly" or "SLR" includes a method of ligating oligonucleotide fragments in a non-stochastic fashion, and explained in detail, below.

Generating and Manipulating Nucleic Acids

The invention provides nucleic acids (e.g., SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:199, SEQ ID NO:161, SEQ ID NO:163, SEQ ID NO:165, SEQ ID NO:167, SEQ BD NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ BD NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377 or SEQ ID NO:379; nucleic acids encoding polypeptides as set forth in SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ BD NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132; SEQ BD NO:134; SEQ ID NO:136; SEQ ID NO:138; SEQ ID NO:140; SEQ ID NO:142; SEQ ID NO:144; NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ D NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ BD NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378 or SEQ ID NO:380), including expression cassettes such as expression vectors, encoding the polypeptides of the invention. The invention also includes methods for discovering new xylanase sequences using the nucleic acids of the invention. The invention also includes methods for inhibiting the expression of xylanase genes, transcripts and polypeptides using the nucleic acids of the invention. Also provided are methods for modifying the nucleic acids of the invention by, e.g., synthetic ligation reassembly, optimized directed evolution system and/or saturation mutagenesis.

The nucleic acids of the invention can be made, isolated and/or manipulated by, e.g., cloning and expression of cDNA libraries, amplification of message or genomic DNA by PCR, and the like. For example, the following exemplary sequences of the invention were initially derived from the following sources:

TABLE 3

| SEQ ID | SOURCE |
|---|---|
| 1, 2 | Bacteria |
| 101, 102 | Environmental |
| 103, 104 | Bacteria |
| 105, 106 | Environmental |
| 107, 108 | Bacteria |
| 109, 110 | Environmental |
| 11, 12 | Environmental |
| 111, 112 | Environmental |
| 113, 114 | Environmental |
| 115, 116 | Environmental |
| 117, 118 | Environmental |
| 119, 120 | Environmental |
| 121, 122 | Environmental |
| 123, 124 | Environmental |
| 125, 126 | Environmental |
| 127, 128 | Environmental |
| 129, 130 | Bacteria |
| 13, 14 | Environmental |
| 131, 132 | Environmental |
| 133, 134 | Environmental |
| 135, 136 | Environmental |
| 137, 138 | Environmental |
| 139, 140 | Environmental |
| 141, 142 | Environmental |
| 143, 144 | Bacteria |
| 145, 146 | Eukaryote |
| 147, 148 | Environmental |
| 149, 150 | Environmental |
| 15, 16 | Environmental |
| 151, 152 | Environmental |
| 153, 154 | Environmental |
| 155, 156 | Environmental |
| 157, 158 | Environmental |
| 159, 160 | Environmental |
| 161, 162 | Environmental |
| 163, 164 | Environmental |
| 165, 166 | Environmental |
| 167, 168 | Environmental |
| 169, 170 | Environmental |
| 17, 18 | Bacteria |
| 171, 172 | Environmental |
| 173, 174 | Environmental |
| 175, 176 | Environmental |
| 177, 178 | Environmental |
| 179, 180 | Environmental |
| 181, 182 | Environmental |
| 183, 184 | Environmental |
| 185, 186 | Environmental |
| 187, 188 | Environmental |
| 189, 190 | Environmental |
| 19, 20 | Environmental |
| 191, 192 | Environmental |
| 193, 194 | Environmental |
| 195, 196 | Environmental |
| 197, 198 | Environmental |
| 199, 200 | Environmental |
| 201, 202 | Environmental |
| 203, 204 | Environmental |
| 205, 206 | Environmental |
| 207, 208 | Environmental |
| 209, 210 | Environmental |
| 21, 22 | Environmental |
| 211, 212 | Environmental |

TABLE 3-continued

| SEQ ID | SOURCE |
|---|---|
| 213, 214 | Environmental |
| 215, 216 | Environmental |
| 217, 218 | Environmental |
| 219, 220 | Environmental |
| 221, 222 | Environmental |
| 223, 224 | Environmental |
| 225, 226 | Environmental |
| 227, 228 | Environmental |
| 229, 230 | Environmental |
| 23, 24 | Environmental |
| 231, 232 | Bacteria |
| 233, 234 | Environmental |
| 235, 236 | Environmental |
| 237, 238 | Environmental |
| 239, 240 | Environmental |
| 241, 242 | Environmental |
| 243, 244 | Environmental |
| 245, 246 | Environmental |
| 247, 248 | Environmental |
| 249, 250 | Environmental |
| 25, 26 | Environmental |
| 251, 252 | Environmental |
| 253, 254 | Environmental |
| 255, 256 | Environmental |
| 257, 258 | Environmental |
| 259, 260 | Environmental |
| 261, 262 | Environmental |
| 263, 264 | Environmental |
| 265, 266 | Environmental |
| 267, 268 | Bacteria |
| 269, 270 | Environmental |
| 27, 28 | Environmental |
| 271, 272 | Environmental |
| 273, 274 | Environmental |
| 275, 276 | Environmental |
| 277, 278 | Environmental |
| 279, 280 | Environmental |
| 281, 282 | Environmental |
| 283, 284 | Environmental |
| 285, 286 | Environmental |
| 287, 288 | Environmental |
| 289, 290 | Environmental |
| 29, 30 | Archaea |
| 291, 292 | Environmental |
| 293, 294 | Environmental |
| 295, 296 | Environmental |
| 297, 298 | Environmental |
| 299, 300 | Environmental |
| 3, 4 | Environmental |
| 301, 302 | Environmental |
| 303, 304 | Environmental |
| 305, 306 | Bacteria |
| 307, 308 | Environmental |
| 309, 310 | Environmental |
| 31, 32 | Environmental |
| 311, 312 | Environmental |
| 313, 314 | Bacteria |
| 315, 316 | Environmental |
| 317, 318 | Environmental |
| 319, 320 | Environmental |
| 321, 322 | Environmental |
| 323, 324 | Environmental |
| 325, 326 | Environmental |
| 327, 328 | Environmental |
| 329, 330 | Environmental |
| 33, 34 | Environmental |
| 331, 332 | Environmental |
| 333, 334 | Environmental |
| 335, 336 | Environmental |
| 337, 338 | Environmental |
| 339, 340 | Environmental |
| 341, 342 | Environmental |
| 343, 344 | Environmental |
| 345, 346 | Environmental |
| 347, 348 | Environmental |
| 349, 350 | Environmental |
| 35, 36 | Environmental |

TABLE 3-continued

| SEQ ID | SOURCE |
| --- | --- |
| 351, 352 | Environmental |
| 353, 354 | Environmental |
| 355, 356 | Environmental |
| 357, 358 | Environmental |
| 359, 360 | Environmental |
| 361, 362 | Environmental |
| 363, 364 | Environmental |
| 365, 366 | Environmental |
| 367, 368 | Environmental |
| 369, 370 | Environmental |
| 37, 38 | Environmental |
| 371, 372 | Environmental |
| 373, 374 | Environmental |
| 375, 376 | Artificial |
| 377, 378 | Artificial |
| 39, 40 | Environmental |
| 41, 42 | Environmental |
| 43, 44 | Environmental |
| 45, 46 | Environmental |
| 47, 48 | Environmental |
| 49, 50 | Environmental |
| 5, 6 | Environmental |
| 51, 52 | Environmental |
| 53, 54 | Bacteria |
| 55, 56 | Environmental |
| 57, 58 | Environmental |
| 59, 60 | Environmental |
| 61, 62 | Environmental |
| 63, 64 | Environmental |
| 65, 66 | Environmental |
| 67, 68 | Environmental |
| 69, 70 | Environmental |
| 7, 8 | Environmental |
| 71, 72 | Environmental |
| 73, 74 | Environmental |
| 75, 76 | Environmental |
| 77, 78 | Environmental |
| 79, 80 | Environmental |
| 81, 82 | Environmental |
| 83, 84 | Environmental |
| 85, 86 | Bacteria |
| 87, 88 | Environmental |
| 89, 90 | Bacteria |
| 9, 10 | Environmental |
| 91, 92 | Environmental |
| 93, 94 | Environmental |
| 95, 96 | Environmental |
| 97, 98 | Environmental |
| 99, 100 | Environmental |

In one aspect, the invention also provides xylanase-encoding nucleic acids with a common novelty in that they are derived from an environmental source, or a bacterial source, or an archaeal source.

In practicing the methods of the invention, homologous genes can be modified by manipulating a template nucleic acid, as described herein. The invention can be practiced in conjunction with any method or protocol or device known in the art, which are well described in the scientific and patent literature.

One aspect of the invention is an isolated nucleic acid comprising one of the sequences of Group A nucleic acid sequences and sequences substantially identical thereto, the sequences complementary thereto, or a fragment comprising at least 10, 15, 20, 25, 30, 35, 40, 50, 75, 100, 150, 200, 300, 400, or 500 consecutive bases of one of the sequences of a Group A nucleic acid sequence (or the sequences complementary thereto). The isolated, nucleic acids may comprise DNA, including cDNA, genomic DNA and synthetic DNA. The DNA may be double-stranded or single-stranded and if single stranded may be the coding strand or non-coding (antisense) strand. Alternatively, the isolated nucleic acids may comprise RNA.

As discussed in more detail below, the isolated nucleic acids of one of the Group A nucleic acid sequences and sequences substantially identical thereto, may be used to prepare one of the polypeptides of a Group B amino acid sequence and sequences substantially identical thereto, or fragments comprising at least 5, 10, 15, 20, 25, 30, 35, 40, 50, 75, 100, or 150 consecutive amino acids of one of the polypeptides of Group B amino acid sequences and sequences substantially identical thereto.

Accordingly, another aspect of the invention is an isolated nucleic acid which encodes one of the polypeptides of Group B amino acid sequences and sequences substantially identical thereto, or fragments comprising at least 5, 10, 15, 20, 25, 30, 35, 40, 50, 75, 100, or 150 consecutive amino acids of one of the polypeptides of the Group B amino acid sequences. The coding sequences of these nucleic acids may be identical to one of the coding sequences of one of the nucleic acids of Group A nucleic acid sequences, or a fragment thereof or may be different coding sequences which encode one of the polypeptides of Group B amino acid sequences, sequences substantially identical thereto and fragments having at least 5, 10, 15, 20, 25, 30, 35, 40, 50, 75, 100, or 150 consecutive amino acids of one of the polypeptides of Group B amino acid sequences, as a result of the redundancy or degeneracy of the genetic code. The genetic code is well known to those of skill in the art and can be obtained, for example, on page 214 of B. Lewin, *Genes VI*, Oxford University Press, 1997.

The isolated nucleic acid which encodes one of the polypeptides of Group B amino acid sequences and sequences substantially identical thereto, may include, but is not limited to: only the coding sequence of one of Group A nucleic acid sequences and sequences substantially identical thereto and additional coding sequences, such as leader sequences or proprotein sequences and non-coding sequences, such as introns or non-coding sequences 5' and/or 3' of the coding sequence. Thus, as used herein, the term "polynucleotide encoding a polypeptide" encompasses a polynucleotide which includes only the coding sequence for the polypeptide as well as a polynucleotide which includes additional coding and/or non-coding sequence.

Alternatively, the nucleic acid sequences of Group A nucleic acid sequences and sequences substantially identical thereto, may be mutagenized using conventional techniques, such as site directed mutagenesis, or other techniques familiar to those skilled in the art, to introduce silent changes into the polynucleotides of Group A nucleic acid sequences and sequences substantially identical thereto. As used herein, "silent changes" include, for example, changes which do not alter the amino acid sequence encoded by the polynucleotide. Such changes may be desirable in order to increase the level of the polypeptide produced by host cells containing a vector encoding the polypeptide by introducing codons or codon pairs which occur frequently in the host organism.

The invention also relates to polynucleotides which have nucleotide changes which result in amino acid substitutions, additions, deletions, fusions and truncations in the polypeptides of Group B amino acid sequences and sequences substantially identical thereto. Such nucleotide changes may be introduced using techniques such as site directed mutagenesis, random chemical mutagenesis, exonuclease III deletion and other recombinant DNA techniques. Alternatively, such nucleotide changes may be naturally occurring allelic variants which are isolated by identifying nucleic acids which specifically hybridize to probes comprising at least 10, 15, 20, 25, 30, 35, 40, 50, 75, 100, 150, 200, 300, 400, or 500 consecutive bases of one of the sequences of Group A nucleic acid sequences and sequences substantially identical thereto (or the sequences complementary thereto) under conditions of high, moderate, or low stringency as provided herein.

General Techniques

The nucleic acids used to practice this invention, whether RNA, iRNA, antisense nucleic acid, cDNA, genomic DNA, vectors, viruses or hybrids thereof, may be isolated from a variety of sources, genetically engineered, amplified, and/or expressed/generated recombinantly. Recombinant polypeptides (e.g., xylanases) generated from these nucleic acids can be individually isolated or cloned and tested for a desired activity. Any recombinant expression system can be used, including bacterial, mammalian, yeast, insect or plant cell expression systems.

Alternatively, these nucleic acids can be synthesized in vitro by well-known chemical synthesis techniques, as described in, e.g., Adams (1983) J. Am. Chem. Soc. 105:661; Belousov (1997) Nucleic Acids Res. 25:3440-3444; Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Tetra. Lett. 22:1859; U.S. Pat. No. 4,458,066.

Techniques for the manipulation of nucleic acids, such as, e.g., subcloning, labeling probes (e.g., random-primer labeling using Klenow polymerase, nick translation, amplification), sequencing, hybridization and the like are well described in the scientific and patent literature, see, e.g., Sambrook, ed., MOLECULAR CLONING: A LABORATORY MANUAL (2ND ED.), Vols. 1-3, Cold Spring Harbor Laboratory, (1989); CURRENT PROTOCOLS IN MOLECULAR BIOLOGY, Ausubel, ed. John Wiley & Sons, Inc., New York (1997); LABORATORY TECHNIQUES IN BIOCHEMISTRY AND MOLECULAR BIOLOGY: HYBRIDIZATION WITH NUCLEIC ACID PROBES, Part I. Theory and Nucleic Acid Preparation, Tijssen, ed. Elsevier, N.Y. (1993).

Another useful means of obtaining and manipulating nucleic acids used to practice the methods of the invention is to clone from genomic samples, and, if desired, screen and re-clone inserts isolated or amplified from, e.g., genomic clones or cDNA clones. Sources of nucleic acid used in the methods of the invention include genomic or cDNA libraries contained in, e.g., mammalian artificial chromosomes (MACs), see, e.g., U.S. Pat. Nos. 5,721,118; 6,025,155; human artificial chromosomes, see, e.g., Rosenfeld (1997) Nat. Genet. 15:333-335; yeast artificial chromosomes (YAC); bacterial artificial chromosomes (BAC); P1 artificial chromosomes, see, e.g., Woon (1998) Genomics 50:306-316; P1-derived vectors (PACs), see, e.g., Kern (1997) Biotechniques 23:120-124; cosmids, recombinant viruses, phages or plasmids.

In one aspect, a nucleic acid encoding a polypeptide of the invention is assembled in appropriate phase with a leader sequence capable of directing secretion of the translated polypeptide or fragment thereof.

The invention provides fusion proteins and nucleic acids encoding them. A polypeptide of the invention can be fused to a heterologous peptide or polypeptide, such as N-terminal identification peptides which impart desired characteristics, such as increased stability or simplified purification. Peptides and polypeptides of the invention can also be synthesized and expressed as fusion proteins with one or more additional domains linked thereto for, e.g., producing a more immunogenic peptide, to more readily isolate a recombinantly synthesized peptide, to identify and isolate antibodies and antibody-expressing B cells, and the like. Detection and purification facilitating domains include, e.g., metal chelating peptides such as polyhistidine tracts and histidine-tryptophan modules that allow purification on immobilized metals, protein A domains that allow purification on immobilized immunoglobulin, and the domain utilized in the FLAGS extension/affinity purification system (Immunex Corp, Seattle Wash.). The inclusion of a cleavable linker sequences such as Factor Xa or enterokinase (Invitrogen, San Diego Calif.) between a purification domain and the motif-comprising peptide or polypeptide to facilitate purification. For example, an expression vector can include an epitope-encoding nucleic acid sequence linked to six histidine residues followed by a thioredoxin and an enterokinase cleavage site (see e.g., Williams (1995) Biochemistry 34:1787-1797; Dobeli (1998) Protein Expr. Purif 12:404-414). The histidine residues facilitate detection and purification while the enterokinase cleavage site provides a means for purifying the epitope from the remainder of the fusion protein. Technology pertaining to vectors encoding fusion proteins and application of fusion proteins are well described in the scientific and patent literature, see e.g., Kroll (1993) DNA Cell. Biol., 12:441-53.

Transcriptional and Translational Control Sequences

The invention provides nucleic acid (e.g., DNA) sequences of the invention operatively linked to expression (e.g., transcriptional or translational) control sequence(s), e.g., promoters or enhancers, to direct or modulate RNA synthesis/expression. The expression control sequence can be in an expression vector. Exemplary bacterial promoters include lacI, lacZ, T3, T7, gpt, lambda PR, PL and trp. Exemplary eukaryotic promoters include CMV immediate early, HSV thymidine kinase, early and late SV40, LTRs from retrovirus, and mouse metallothionein I.

Promoters suitable for expressing a polypeptide in bacteria include the E. coli lac or trp promoters, the lacI promoter, the lacZ promoter, the T3 promoter, the T7 promoter, the gpt promoter, the lambda PR promoter, the lambda PL promoter, promoters from operons encoding glycolytic enzymes such as 3-phosphoglycerate kinase (PGK), and the acid phosphatase promoter. Eukaryotic promoters include the CMV immediate early promoter, the HSV thymidine kinase promoter, heat shock promoters, the early and late SV40 promoter, LTRs from retroviruses, and the mouse metallothionein-I promoter. Other promoters known to control expression of genes in prokaryotic or eukaryotic cells or their viruses may also be used. Promoters suitable for expressing the polypeptide or fragment thereof in bacteria include the E. coli lac or trp promoters, the lac promoter, the lacZ promoter, the T3 promoter, the T7 promoter, the gpt promoter, the lambda $P_R$ promoter, the lambda $P_L$ promoter, promoters from operons encoding glycolytic enzymes such as 3-phosphoglycerate kinase (PGK) and the acid phosphatase promoter. Fungal promoters include the α factor promoter. Eukaryotic promoters include the CMV immediate early promoter, the HSV thymidine kinase promoter, heat shock promoters, the early and late SV40 promoter, LTRs from retroviruses and the mouse metallothionein-I promoter. Other promoters known to control expression of genes in prokaryotic or eukaryotic cells or their viruses may also be used.

Tissue-Specific Plant Promoters

The invention provides expression cassettes that can be expressed in a tissue-specific manner, e.g., that can express a xylanase of the invention in a tissue-specific manner. The invention also provides plants or seeds that express a xylanase of the invention in a tissue-specific manner. The tissue-specificity can be seed specific, stem specific, leaf specific, root specific, fruit specific and the like.

In one aspect, a constitutive promoter such as the CaMV 35S promoter can be used for expression in specific parts of the plant or seed or throughout the plant. For example, for overexpression, a plant promoter fragment can be employed which will direct expression of a nucleic acid in some or all tissues of a plant, e.g., a regenerated plant. Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or 2'-promoter derived from T-DNA of *Agrobacterium tumefaciens*, and other transcription initiation regions from various plant genes known to those of skill. Such genes include, e.g., ACT11 from *Arabidopsis* (Huang (1996) *Plant Mol. Biol.* 33:125-139); Cat3 from *Arabidopsis* (GenBank No. U43147, Zhong (1996) *Mol. Gen. Genet.* 251:196-203); the gene encoding stearoyl-acyl carrier protein desaturase from *Brassica napus* (Genbank No. X74782, Solocombe (1994) *Plant Physiol.* 104: 1167-1176); GPc1 from maize (GenBank No. X15596; Martinez (1989) *J. Mol. Biol.* 208:551-565); the Gpc2 from maize (GenBank No. U45855, Manjunath (1997) *Plant Mol. Biol.* 33:97-112); plant promoters described in U.S. Pat. Nos. 4,962,028; 5,633,440.

The invention uses tissue-specific or constitutive promoters derived from viruses which can include, e.g., the tobamovirus subgenomic promoter (Kumagai (1995) Proc. Natl. Acad. Sci. USA 92:1679-1683; the rice tungro bacilliform virus (RTBV), which replicates only in phloem cells in infected rice plants, with its promoter which drives strong phloem-specific reporter gene expression; the cassava vein mosaic virus (CVMV) promoter, with highest activity in vascular elements, in leaf mesophyll cells, and in root tips (Verdaguer (1996) Plant Mol. Biol. 31:1129-1139).

Alternatively, the plant promoter may direct expression of xylanase-expressing nucleic acid in a specific tissue, organ or cell type (i.e. tissue-specific promoters) or may be otherwise under more precise environmental or developmental control or under the control of an inducible promoter. Examples of environmental conditions that may affect transcription include anaerobic conditions, elevated temperature, the presence of light, or sprayed with chemicals/hormones. For example, the invention incorporates the drought-inducible promoter of maize (Busk (1997) supra); the cold, drought, and high salt inducible promoter from potato (Kirch (1997) Plant Mol. Biol. 33:897 909).

Tissue-specific promoters can promote transcription only within a certain time frame of developmental stage within that tissue. See, e.g., Blazquez (1998) Plant Cell 10:791-800, characterizing the *Arabidopsis* LEAFY gene promoter. See also Cardon (1997) *Plant J* 12:367-77, describing the transcription factor SPL3, which recognizes a conserved sequence motif in the promoter region of the *A. thaliana* floral meristem identity gene AP1; and Mandel (1995) Plant Molecular Biology, Vol. 29, pp 995-1004, describing the meristem promoter eIF4. Tissue specific promoters which are active throughout the life cycle of a particular tissue can be used. In one aspect, the nucleic acids of the invention are operably linked to a promoter active primarily only in cotton fiber cells. In one aspect, the nucleic acids of the invention are operably linked to a promoter active primarily during the stages of cotton fiber cell elongation, e.g., as described by Rinehart (1996) supra. The nucleic acids can be operably linked to the Fb12A gene promoter to be preferentially expressed in cotton fiber cells (Ibid). See also, John (1997) Proc. Natl. Acad. Sci. USA 89:5769-5773; John, et al., U.S. Pat. Nos. 5,608,148 and 5,602,321, describing cotton fiber-specific promoters and methods for the construction of transgenic cotton plants. Root-specific promoters may also be used to express the nucleic acids of the invention. Examples of root-specific promoters include the promoter from the alcohol dehydrogenase gene (DeLisle (1990) Int. Rev. Cytol. 123:39-60). Other promoters that can be used to express the nucleic acids of the invention include, e.g., ovule-specific, embryo-specific, endosperm-specific, integument-specific, seed coat-specific promoters, or some combination thereof; a leaf-specific promoter (see, e.g., Busk (1997) Plant J. 11:1285 1295, describing a leaf-specific promoter in maize); the ORF13 promoter from *Agrobacterium rhizogenes* (which exhibits high activity in roots, see, e.g., Hansen (1997) supra); a maize pollen specific promoter (see, e.g., Guerrero (1990) Mol. Gen. Genet. 224:161 168); a tomato promoter active during fruit ripening, senescence and abscission of leaves and, to a lesser extent, of flowers can be used (see, e.g., Blume (1997) Plant J. 12:731 746); a pistil-specific promoter from the potato SK2 gene (see, e.g., Ficker (1997) Plant Mol. Biol. 35:425 431); the Blec4 gene from pea, which is active in epidermal tissue of vegetative and floral shoot apices of transgenic alfalfa making it a useful tool to target the expression of foreign genes to the epidermal layer of actively growing shoots or fibers; the ovule-specific BEL1 gene (see, e.g., Reiser (1995) Cell 83:735-742, GenBank No. U39944); and/ or, the promoter in Klee, U.S. Pat. No. 5,589,583, describing a plant promoter region is capable of conferring high levels of transcription in meristematic tissue and/or rapidly dividing cells.

Alternatively, plant promoters which are inducible upon exposure to plant hormones, such as auxins, are used to express the nucleic acids of the invention. For example, the invention can use the auxin-response elements E1 promoter fragment (AuxREs) in the soybean (*Glycine max* L.) (Liu (1997) Plant Physiol. 115:397-407); the auxin-responsive *Arabidopsis* GST6 promoter (also responsive to salicylic acid and hydrogen peroxide) (Chen (1996) Plant J. 10: 955-966); the auxin-inducible parC promoter from tobacco (Sakai (1996) 37:906-913); a plant biotin response element (Streit (1997) Mol. Plant Microbe Interact. 10:933-937); and, the promoter responsive to the stress hormone abscisic acid (Sheen (1996) Science 274:1900-1902).

The nucleic acids of the invention can also be operably linked to plant promoters which are inducible upon exposure to chemicals reagents which can be applied to the plant, such as herbicides or antibiotics. For example, the maize In2-2 promoter, activated by benzenesulfonamide herbicide safeners, can be used (De Veylder (1997) Plant Cell Physiol. 38:568-577); application of different herbicide safeners induces distinct gene expression patterns, including expression in the root, hydathodes, and the shoot apical meristem. Coding sequence can be under the control of, e.g., a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324). Using chemically- (e.g., hormone- or pesticide-) induced promoters, i.e., promoter responsive to a chemical which can be applied to the transgenic plant in the field, expression of a polypeptide of the invention can be induced at a particular stage of development of the plant. Thus, the invention also provides for transgenic plants containing an inducible gene encoding for polypeptides of the invention whose host range is limited to target plant species, such as corn, rice, barley, wheat, potato or other crops, inducible at any stage of development of the crop.

One of skill will recognize that a tissue-specific plant promoter may drive expression of operably linked sequences in tissues other than the target tissue. Thus, a tissue-specific promoter is one that drives expression preferentially in the target tissue or cell type, but may also lead to some expression in other tissues as well.

The nucleic acids of the invention can also be operably linked to plant promoters which are inducible upon exposure to chemicals reagents. These reagents include, e.g., herbicides, synthetic auxins, or antibiotics which can be applied, e.g., sprayed, onto transgenic plants. Inducible expression of the xylanase-producing nucleic acids of the invention will allow the grower to select plants with the optimal xylanase expression and/or activity. The development of plant parts can thus controlled. In this way the invention provides the means to facilitate the harvesting of plants and plant parts. For example, in various embodiments, the maize In2-2 promoter, activated by benzenesulfonamide herbicide safeners, is used (De Veylder (1997) Plant Cell Physiol. 38:568-577); application of different herbicide safeners induces distinct gene expression patterns, including expression in the root, hydathodes, and the shoot apical meristem. Coding sequences of the invention are also under the control of a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324).

In some aspects, proper polypeptide expression may require polyadenylation region at the 3'-end of the coding region. The polyadenylation region can be derived from the natural gene, from a variety of other plant (or animal or other) genes, or from genes in the Agrobacterial T-DNA.

Expression Vectors and Cloning Vehicles

The invention provides expression vectors and cloning vehicles comprising nucleic acids of the invention, e.g., sequences encoding the xylanases of the invention. Expression vectors and cloning vehicles of the invention can comprise viral particles, baculovirus, phage, plasmids, phagemids, cosmids, fosmids, bacterial artificial chromosomes, viral DNA (e.g., vaccinia, adenovirus, foul pox virus, pseudorabies and derivatives of SV40), P1-based artificial chromosomes, yeast plasmids, yeast artificial chromosomes, and any other vectors specific for specific hosts of interest (such as *bacillus, Aspergillus* and yeast). Vectors of the invention can include chromosomal, non-chromosomal and synthetic DNA sequences. Large numbers of suitable vectors are known to those of skill in the art, and are commercially available. Exemplary vectors are include: bacterial: pQE vectors (Qiagen), pBluescript plasmids, pNH vectors, (lambda-ZAP vectors (Stratagene); ptrc99a, pKK223-3, pDR540, pRIT2T (Pharmacia); Eukaryotic: pXT1, pSG5 (Stratagene), pSVK3, pBPV, pMSG, pSVLSV40 (Pharmacia). However, any other plasmid or other vector may be used so long as they are replicable and viable in the host. Low copy number or high copy number vectors may be employed with the present invention.

The expression vector can comprise a promoter, a ribosome binding site for translation initiation and a transcription terminator. The vector may also include appropriate sequences for amplifying expression. Mammalian expression vectors can comprise an origin of replication, any necessary ribosome binding sites, a polyadenylation site, splice donor and acceptor sites, transcriptional termination sequences, and 5' flanking non-transcribed sequences. In some aspects, DNA sequences derived from the SV40 splice and polyadenylation sites may be used to provide the required non-transcribed genetic elements.

In one aspect, the expression vectors contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli*, and the *S. cerevisiae* TRP1 gene. Promoter regions can be selected from any desired gene using chloramphenicol transferase (CAT) vectors or other vectors with selectable markers.

Vectors for expressing the polypeptide or fragment thereof in eukaryotic cells can also contain enhancers to increase expression levels. Enhancers are cis-acting elements of DNA, usually from about 10 to about 300 bp in length that act on a promoter to increase its transcription. Examples include the SV40 enhancer on the late side of the replication origin bp 100 to 270, the cytomegalovirus early promoter enhancer, the polyoma enhancer on the late side of the replication origin, and the adenovirus enhancers.

A nucleic acid sequence can be inserted into a vector by a variety of procedures. In general, the sequence is ligated to the desired position in the vector following digestion of the insert and the vector with appropriate restriction endonucleases. Alternatively, blunt ends in both the insert and the vector may be ligated. A variety of cloning techniques are known in the art, e.g., as described in Ausubel and Sambrook. Such procedures and others are deemed to be within the scope of those skilled in the art.

The vector can be in the form of a plasmid, a viral particle, or a phage. Other vectors include chromosomal, non-chromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus, and pseudorabies. A variety of cloning and expression vectors for use with prokaryotic and eukaryotic hosts are described by, e.g., Sambrook.

Particular bacterial vectors which can be used include the commercially available plasmids comprising genetic elements of the well known cloning vector pBR322 (ATCC 37017), pKK223-3 (Pharmacia Fine Chemicals, Uppsala, Sweden), GEM1 (Promega Biotec, Madison, Wis., USA) pQE70, pQE60, pQE-9 (Qiagen), pD10, psiX174 pBluescript II KS, pNH8A, pNH16a, pNH18A, pNH46A (Stratagene), ptrc99a, pKK223-3, pKK233-3, DR540, pRIT5 (Pharmacia), pKK232-8 and pCM7. Particular eukaryotic vectors include pSV2CAT, pOG44, pXT1, pSG (Stratagene) pSVK3, pBPV, pMSG, and pSVL (Pharmacia). However, any other vector may be used as long as it is replicable and viable in the host cell.

The nucleic acids of the invention can be expressed in expression cassettes, vectors or viruses and transiently or stably expressed in plant cells and seeds. One exemplary transient expression system uses episomal expression systems, e.g., cauliflower mosaic virus (CaMV) viral RNA generated in the nucleus by transcription of an episomal mini-chromosome containing supercoiled DNA, see, e.g., Covey (1990) Proc. Natl. Acad. Sci. USA 87:1633-1637. Alternatively, coding sequences, i.e., all or sub-fragments of sequences of the invention can be inserted into a plant host cell genome becoming an integral part of the host chromosomal DNA. Sense or antisense transcripts can be expressed in this manner. A vector comprising the sequences (e.g., promoters or coding regions) from nucleic acids of the invention can comprise a marker gene that confers a selectable phenotype on a plant cell or a seed. For example, the marker may encode biocide resistance, particularly antibiotic resistance, such as resistance to kanamycin, G418, bleomycin, hygromycin, or herbicide resistance, such as resistance to chlorosulfuron or Basta.

Expression vectors capable of expressing nucleic acids and proteins in plants are well known in the art, and can include, e.g., vectors from *Agrobacterium* spp., potato virus X (see, e.g., Angell (1997) EMBO J. 16:3675-3684), tobacco mosaic virus (see, e.g., Casper (1996) Gene 173:69-73), tomato bushy stunt virus (see, e.g., Hillman (1989) Virology 169:42-50), tobacco etch virus (see, e.g., Dolja (1997) Virology 234: 243-252), bean golden mosaic virus (see, e.g., Morinaga (1993) Microbiol Immunol. 37:471-476), cauliflower mosaic virus (see, e.g., Cecchini (1997) Mol. Plant Microbe Interact. 10: 1094-1101), maize Ac/Ds transposable element (see, e.g., Rubin (1997) Mol. Cell. Biol. 17:6294-6302; Kunze (1996) Curr. Top. Microbiol. Immunol. 204:161-194), and the maize suppressor-mutator (Spm) transposable element (see, e.g., Schlappi (1996) Plant Mol. Biol. 32:717-725); and derivatives thereof.

In one aspect, the expression vector can have two replication systems to allow it to be maintained in two organisms, for example in mammalian or insect cells for expression and in a prokaryotic host for cloning and amplification. Furthermore, for integrating expression vectors, the expression vector can contain at least one sequence homologous to the host cell genome. It can contain two homologous sequences which flank the expression construct. The integrating vector can be directed to a specific locus in the host cell by selecting the appropriate homologous sequence for inclusion in the vector. Constructs for integrating vectors are well known in the art.

Expression vectors of the invention may also include a selectable marker gene to allow for the selection of bacterial strains that have been transformed, e.g., genes which render the bacteria resistant to drugs such as ampicillin, chloramphenicol, erythromycin, kanamycin, neomycin and tetracycline. Selectable markers can also include biosynthetic genes, such as those in the histidine, tryptophan and leucine biosynthetic pathways.

The DNA sequence in the expression vector is operatively linked to an appropriate expression control sequence(s) (promoter) to direct RNA synthesis. Particular named bacterial promoters include lacI, lacZ, T3, T7, gpt, lambda $P_R$, $P_L$ and trp. Eukaryotic promoters include CMV immediate early, HSV thymidine kinase, early and late SV40, LTRs from retrovirus and mouse metallothionein-I. Selection of the appropriate vector and promoter is well within the level of ordinary skill in the art. The expression vector also contains a ribosome binding site for translation initiation and a transcription terminator. The vector may also include appropriate sequences for amplifying expression. Promoter regions can be selected from any desired gene using chloramphenicol transferase (CAT) vectors or other vectors with selectable markers. In addition, the expression vectors preferably contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

Mammalian expression vectors may also comprise an origin of replication, any necessary ribosome binding sites, a polyadenylation site, splice donor and acceptor sites, transcriptional termination sequences and 5' flanking nontranscribed sequences. In some aspects, DNA sequences derived from the SV40 splice and polyadenylation sites may be used to provide the required nontranscribed genetic elements.

Vectors for expressing the polypeptide or fragment thereof in eukaryotic cells may also contain enhancers to increase expression levels. Enhancers are cis-acting elements of DNA, usually from about 10 to about 300 bp in length that act on a promoter to increase its transcription. Examples include the SV40 enhancer on the late side of the replication origin bp 100 to 270, the cytomegalovirus early promoter enhancer, the polyoma enhancer on the late side of the replication origin and the adenovirus enhancers.

In addition, the expression vectors typically contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli* and the *S. cerevisiae* TRP1 gene.

In some aspects, the nucleic acid encoding one of the polypeptides of Group B amino acid sequences and sequences substantially identical thereto, or fragments comprising at least about 5, 10, 15, 20, 25, 30, 35, 40, 50, 75, 100, or 150 consecutive amino acids thereof is assembled in appropriate phase with a leader sequence capable of directing secretion of the translated polypeptide or fragment thereof. Optionally, the nucleic acid can encode a fusion polypeptide in which one of the polypeptides of Group B amino acid sequences and sequences substantially identical thereto, or fragments comprising at least 5, 10, 15, 20, 25, 30, 35, 40, 50, 75, 100, or 150 consecutive amino acids thereof is fused to heterologous peptides or polypeptides, such as N-terminal identification peptides which impart desired characteristics, such as increased stability or simplified purification.

The appropriate DNA sequence may be inserted into the vector by a variety of procedures. In general, the DNA sequence is ligated to the desired position in the vector following digestion of the insert and the vector with appropriate restriction endonucleases. Alternatively, blunt ends in both the insert and the vector may be ligated. A variety of cloning techniques are disclosed in Ausubel et al. Current Protocols in Molecular Biology, John Wiley 503 Sons, Inc. 1997 and Sambrook et al., *Molecular Cloning: A Laboratory Manual 2nd Ed.*, Cold Spring Harbor Laboratory Press (1989. Such procedures and others are deemed to be within the scope of those skilled in the art.

The vector may be, for example, in the form of a plasmid, a viral particle, or a phage. Other vectors include chromosomal, nonchromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus and pseudorabies. A variety of cloning and expression vectors for use with prokaryotic and eukaryotic hosts are described by Sambrook, et al., *Molecular Cloning: A Laboratory Manual, 2nd Ed.*, Cold Spring Harbor, N.Y., (1989).

Host Cells and Transformed Cells

The invention also provides a transformed cell comprising a nucleic acid sequence of the invention, e.g., a sequence encoding a xylanase of the invention, or a vector of the invention. The host cell may be any of the host cells familiar to those skilled in the art, including prokaryotic cells, eukaryotic cells, such as bacterial cells, fungal cells, yeast cells, mammalian cells, insect cells, or plant cells. Exemplary bacterial cells include *E. coli, Streptomyces, Bacillus subtilis, Salmonella typhimurium* and various species within the genera *Pseudomonas, Streptoinyces*, and *Staphlylococcus*. Exemplary insect cells include *Drosophila* S2 and *Spodoptera* Sf9. Exemplary animal cells include CHO, COS or Bowes melanoma or any mouse or human cell line. The selection of an appropriate host is within the abilities of those skilled in the art. Techniques for transforming a wide variety of higher plant species are well known and described in the technical and scientific literature. See, e.g., Weising (1988) Ann. Rev. Genet. 22:421477; U.S. Pat. No. 5,750,870.

The vector can be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

In one aspect, the nucleic acids or vectors of the invention are introduced into the cells for screening, thus, the nucleic acids enter the cells in a manner suitable for subsequent expression of the nucleic acid. The method of introduction is largely dictated by the targeted cell type. Exemplary methods include $CaPO_4$ precipitation, liposome fusion, lipofection (e.g., LIPOFECTIN™), electroporation, viral infection, etc. The candidate nucleic acids may stably integrate into the genome of the host cell (for example, with retroviral introduction) or may exist either transiently or stably in the cytoplasm (i.e. through the use of traditional plasmids, utilizing standard regulatory sequences, selection markers, etc.). As many pharmaceutically important screens require human or model mammalian cell targets, retroviral vectors capable of transfecting such targets are can be used.

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells can be harvested by centrifugation, disrupted by physical or chemical means, and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Cell-free translation systems can also be employed to produce a polypeptide of the invention. Cell-free translation systems can use mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

The expression vectors can contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

Host cells containing the polynucleotides of interest, e.g., nucleic acids of the invention, can be cultured in conventional nutrient media modified as appropriate for activating promoters, selecting transformants or amplifying genes. The culture conditions, such as temperature, pH and the like, are those previously used with the host cell selected for expression and will be apparent to the ordinarily skilled artisan. The clones which are identified as having the specified enzyme activity may then be sequenced to identify the polynucleotide sequence encoding an enzyme having the enhanced activity.

The invention provides a method for overexpressing a recombinant xylanase in a cell comprising expressing a vector comprising a nucleic acid of the invention, e.g., a nucleic acid comprising a nucleic acid sequence with at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to a sequence of Group A nucleic acid sequences over a region of at least about 100 residues, wherein the sequence identities are determined by analysis with a sequence comparison algorithm or by visual inspection, or, a nucleic acid that hybridizes under stringent conditions to a nucleic acid sequence as set forth in Group A nucleic acid sequences, or a subsequence thereof. The overexpression can be effected by any means, e.g., use of a high activity promoter, a dicistronic vector or by gene amplification of the vector.

The nucleic acids of the invention can be expressed, or overexpressed, in any in vitro or in vivo expression system. Any cell culture systems can be employed to express, or over-express, recombinant protein, including bacterial, insect, yeast, fungal or mammalian cultures. Over-expression can be effected by appropriate choice of promoters, enhancers, vectors (e.g., use of replicon vectors, dicistronic vectors (see, e.g., Gurtu (1996) Biochem. Biophys. Res. Commun. 229:295-8), media, culture systems and the like. In one aspect, gene amplification using selection markers, e.g., glutamine synthetase (see, e.g., Sanders (1987) Dev. Biol. Stand. 66:55-63), in cell systems are used to overexpress the polypeptides of the invention.

Additional details regarding this approach are in the public literature and/or are known to the skilled artisan. In a particular non-limiting exemplification, such publicly available literature includes EP 0659215 (WO 9403612 A1) (Nevalainen et al.); Lapidot, A., Mechaly, A., Shoham, Y., "Overexpression and single-step purification of a thermostable xylanase from *Bacillus stearothermophilus* T-6," J. Biotechnol. Nov 51:259-64 (1996); Lüthi, E., Jasmat, N. B., Bergquist, P. L., "Xylanase from the extremely thermophilic bacterium *Caldocellum saccharolyticum*: overexpression of the gene in *Escherichia coli* and characterization of the gene product," Appl. Environ. Microbiol. Sep 56:2677-83 (1990); and Sung, W. L., Luk, C. K., Zahab, D. M., Wakarchuk, W., "Overexpression of the *Bacillus subtilis* and circulans xylanases in

*Escherichia coli*," Protein Expr. Purif. Jun 4:200-6 (1993), although these references do not teach the inventive enzymes of the instant application.

The host cell may be any of the host cells familiar to those skilled in the art, including prokaryotic cells, eukaryotic cells, mammalian cells, insect cells, or plant cells. As representative examples of appropriate hosts, there may be mentioned: bacterial cells, such as *E. coli, Streptomyces, Bacillus subtilis, Salmonella typhimurium* and various species within the genera *Pseudomonas, Streptomyces* and *Staphylococcus*, fungal cells, such as yeast, insect cells such as *Drosophila* S2 and *Spodoptera* Sf9, animal cells such as CHO, COS or Bowes melanoma and adenoviruses. The selection of an appropriate host is within the abilities of those skilled in the art.

The vector may be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells are typically harvested by centrifugation, disrupted by physical or chemical means and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

Various mammalian cell culture systems can also be employed to express recombinant protein. Examples of mammalian expression systems include the COS-7 lines of monkey kidney fibroblasts (described by Gluzman, Cell, 23:175, 1981) and other cell lines capable of expressing proteins from a compatible vector, such as the C127, 3T3, CHO, HeLa and BHK cell lines.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Alternatively, the polypeptides of Group B amino acid sequences and sequences substantially identical thereto, or fragments comprising at least 5, 10, 15, 20, 25, 30, 35, 40, 50, 75, 100, or 150 consecutive amino acids thereof can be synthetically produced by conventional peptide synthesizers. In other aspects, fragments or portions of the polypeptides may be employed for producing the corresponding full-length polypeptide by peptide synthesis; therefore, the fragments may be employed as intermediates for producing the full-length polypeptides.

Cell-free translation systems can also be employed to produce one of the polypeptides of Group B amino acid sequences and sequences substantially identical thereto, or fragments comprising at least 5, 10, 15, 20, 25, 30, 35, 40, 50, 75, 100, or 150 consecutive amino acids thereof using mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

Amplification of Nucleic Acids

In practicing the invention, nucleic acids of the invention and nucleic acids encoding the xylanases of the invention, or modified nucleic acids of the invention, can be reproduced by amplification. Amplification can also be used to clone or modify the nucleic acids of the invention. Thus, the invention provides amplification primer sequence pairs for amplifying nucleic acids of the invention. One of skill in the art can design amplification primer sequence pairs for any part of or the full length of these sequences.

In one aspect, the invention provides a nucleic acid amplified by a primer pair of the invention, e.g., a primer pair as set forth by about the first (the 5') 12, 13, 14, 15, 16, 17, 18, 19, 20, 21, 22, 23, 24, or 25 residues of a nucleic acid of the invention, and about the first (the 5') 15, 16, 17, 18, 19, 20, 21, 22, 23, 24, or 25 residues of the complementary strand.

The invention provides an amplification primer sequence pair for amplifying a nucleic acid encoding a polypeptide having a xylanase activity, wherein the primer pair is capable of amplifying a nucleic acid comprising a sequence of the invention, or fragments or subsequences thereof. One or each member of the amplification primer sequence pair can comprise an oligonucleotide comprising at least about 10 to 50 consecutive bases of the sequence, or about 12, 13, 14, 15, 16, 17, 18, 19, 20, 21, 22, 23, 24, or 25 consecutive bases of the sequence. The invention provides amplification primer pairs, wherein the primer pair comprises a first member having a sequence as set forth by about the first (the 5') 12, 13, 14, 15, 16, 17, 18, 19, 20, 21, 22, 23, 24, or 25 residues of a nucleic acid of the invention, and a second member having a sequence as set forth by about the first (the 5') 12, 13, 14, 15, 16, 17, 18, 19, 20, 21, 22, 23, 24, or 25 residues of the complementary strand of the first member. The invention provides xylanases generated by amplification, e.g., polymerase chain reaction (PCR), using an amplification primer pair of the invention. The invention provides methods of making a xylanase by amplification, e.g., polymerase chain reaction (PCR), using an amplification primer pair of the invention. In one aspect, the amplification primer pair amplifies a nucleic acid from a library, e.g., a gene library, such as an environmental library.

Amplification reactions can also be used to quantify the amount of nucleic acid in a sample (such as the amount of message in a cell sample), label the nucleic acid (e.g., to apply it to an array or a blot), detect the nucleic acid, or quantify the amount of a specific nucleic acid in a sample. In one aspect of the invention, message isolated from a cell or a cDNA library are amplified.

The skilled artisan can select and design suitable oligonucleotide amplification primers. Amplification methods are also well known in the art, and include, e.g., polymerase chain reaction, PCR (see, e.g., PCR PROTOCOLS, A GUIDE TO METHODS AND APPLICATIONS, ed. Innis, Academic Press, N.Y. (1990) and PCR STRATEGIES (1995), ed. Innis, Academic Press, Inc., N.Y., ligase chain reaction (LCR) (see, e.g., Wu (1989) Genomics 4:560; Landegren (1988) Science 241:1077; Barringer (1990) Gene 89:117); transcription amplification (see, e.g., Kwoh (1989) Proc. Natl. Acad. Sci. USA 86:1173); and, self-sustained sequence replication (see, e.g., Guatelli (1990) Proc. Natl. Acad. Sci. USA 87:1874); Q Beta replicase amplification (see, e.g., Smith (1997) J. Clin. Microbiol. 35:1477-1491), automated Q-beta replicase amplification assay (see, e.g., Burg (1996) Mol. Cell. Probes 10:257-271) and other RNA polymerase mediated techniques (e.g., NASBA, Cangene, Mississauga, Ontario); see also Berger (1987) Methods Enzymol. 152:307-316; Sambrook; Ausubel; U.S. Pat. Nos. 4,683,195 and 4,683,202; Sooknanan (1995) Biotechnology 13:563-564.

Determining the Degree of Sequence Identity

The invention provides nucleic acids comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention (e.g., SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ BD NO:147, SEQ ID NO:149, SEQ ID NO:151, SEQ ID NO:153, SEQ ID NO:155, SEQ ID NO:157, SEQ ID NO:199, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ D NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ BD NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377 or SEQ ID NO:379) over a region of at least about 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more, residues. The invention provides polypeptides comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary polypeptide of the invention. The extent of sequence identity (homology) may be determined using any computer program and associated parameters, including those described herein, such as BLAST 2.2.2. or FASTA version 3.0t78, with the default parameters.

The nucleic acid sequences are also referred to as "Group A" nucleic acid sequences, which include sequences substantially identical thereto, as well as sequences homologous to Group A nucleic acid sequences and fragments thereof and sequences complementary to all of the preceding sequences. Nucleic acid sequences of the invention can comprise at least 10, 15, 20, 25, 30, 35, 40, 50, 75, 100, 150, 200, 300, 400, or 500 consecutive nucleotides of an exemplary sequence of the invention (e.g., Group A nucleic acid sequences) and sequences substantially identical thereto. Homologous sequences and fragments of Group A nucleic acid sequences and sequences substantially identical thereto, refer to a sequence having at least 99%, 98%, 97%, 96%, 95%, 90%, 85%, 80%, 75%, 70%, 65%, 60%, 55%, or 50% homology to these sequences. Homology may be determined using any of the computer programs and parameters described herein, including FASTA version 3.0t78 with the default parameters. Homologous sequences also include RNA sequences in which uridines replace the thymines in the nucleic acid sequences as set forth in the Group A nucleic acid sequences. The homologous sequences may be obtained using any of the procedures described herein or may result from the correction of a sequencing error. It will be appreciated that the nucleic acid sequences as set forth in Group A nucleic acid sequences and sequences substantially identical thereto, can be represented in the traditional single character format (See the inside back cover of Stryer, Lubert. Biochemistry, 3rd Ed., W.

H Freeman & Co., New York.) or in any other format which records the identity of the nucleotides in a sequence.

Various sequence comparison programs identified elsewhere in this patent specification are particularly contemplated for use in this aspect of the invention. Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA and CLUSTALW (Pearson and Lipman, Proc. Natl. Acad. Sci. USA 85(8):2444-2448, 1988; Altschul et al., J. Mol. Biol. 215(3):403-410, 1990; Thompson et al., Nucleic Acids Res. 22(2):4673-4680, 1994; Higgins et al., Methods Enzymol. 266:383-402, 1996; Altschul et al., J. Mol. Biol. 215(3):403-410, 1990; Altschul et al., Nature Genetics 3:266-272, 1993).

Homology or identity is often measured using sequence analysis software (e.g., Sequence Analysis Software Package of the Genetics Computer Group, University of Wisconsin Biotechnology Center, 1710 University Avenue, Madison, Wis. 53705). Such software matches similar sequences by assigning degrees of homology to various deletions, substitutions and other modifications. The terms "homology" and "identity" in the context of two or more nucleic acids or polypeptide sequences, refer to two or more sequences or subsequences that are the same or have a specified percentage of amino acid residues or nucleotides that are the same when compared and aligned for maximum correspondence over a comparison window or designated region as measured using any number of sequence comparison algorithms or by manual alignment and visual inspection.

For sequence comparison, typically one sequence acts as a reference sequence, to which test sequences are compared. When using a sequence comparison algorithm, test and reference sequences are entered into a computer, subsequence coordinates are designated, if necessary and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequence for comparison are well-known in the art. Optimal alignment of sequences for comparison can be conducted, e.g., by the local homology algorithm of Smith & Waterman, Adv. Appl. Math. 2:482, 1981, by the homology alignment algorithm of Needleman & Wunsch, J. Mol. Biol. 48:443, 1970, by the search for similarity method of person & Lipman, Proc. Nat'l. Acad. Sci. USA 85:2444, 1988, by computerized implementations of these algorithms (GAP, BEST-FIT, FASTA and TFASTA in the Wisconsin Genetics Software Package, Genetics Computer Group, 575 Science Dr., Madison, Wis.), or by manual alignment and visual inspection. Other algorithms for determining homology or identity include, for example, in addition to a BLAST program (Basic Local Alignment Search Tool at the National Center for Biological Information), ALIGN, AMAS (Analysis of Multiply Aligned Sequences), AMPS (Protein Multiple Sequence Alignment), ASSET (Aligned Segment Statistical Evaluation Tool), BANDS, BESTSCOR, BIOSCAN (Biological Sequence Comparative Analysis Node), BLIMPS (BLocks IMproved Searcher), FASTA, Intervals & Points, BMB, CLUSTAL V, CLUSTAL W, CONSENSUS, LCONSENSUS, WCONSENSUS, Smith-Waterman algorithm, DARWIN, Las Vegas algorithm, FNAT (Forced Nucleotide Alignment Tool), Framealign, Framesearch, DYNAMIC, FILTER, FSAP (Fristensky Sequence Analysis Package), GAP (Global Alignment Program), GENAL, GIBBS, GenQuest, ISSC (Sensitive Sequence Comparison), LALIGN (Local Sequence Alignment), LCP (Local Content Program), MACAW (Multiple Alignment Construction & Analysis Workbench), MAP (Multiple Alignment Program), MBLKP, MBLKN, PIMA (Pattern-Induced Multi-sequence Alignment), SAGA (Sequence Alignment by Genetic Algorithm) and WHAT-IF. Such alignment programs can also be used to screen genome databases to identify polynucleotide sequences having substantially identical sequences. A number of genome databases are available, for example, a substantial portion of the human genome is available as part of the Human Genome Sequencing Project (J. Roach, http://weber. u.Washington.edu/~roach/human_genome_progress 2.html) (Gibbs, 1995). At least twenty-one other genomes have already been sequenced, including, for example, *M genitalium* (Fraser et al., 1995), *M. jannaschii* (Bult et al., 1996), *H. influenzae* (Fleischmann et at, 1995), *E. coli* (Blattner et al., 1997) and yeast (*S. cerevisiae*) (Mewes et al., 1997) and *D. melanogaster* (Adams et al, 2000). Significant progress has also been made in sequencing the genonies of model organism, such as mouse, *C. elegans* and *Arabadopsis* sp. Several databases containing genomic information annotated with some functional information are maintained by different organization and are accessible via the internet One example of a useful algorithm is BLAST and BLAST 2.0 algorithms, which are described in Altschul et al., Nuc. Acids Res. 25:3389-3402, 1977 and Altschul et al, J. Mol. Biol. 215:403-410, 1990, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al, supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, an expectation (E) of 10, M=5, N-4 and a comparison of both strands. For amino acid sequences, the BLASTP program uses as defaults a wordlength of 3 and expectations (E) of 10 and the BLOSUM62 scoring matrix (see Henikoff & Henikoff, Proc. Natl. Acad. Sci. USA 89:10915, 1989) alignments (B) of 50, expectation (E) of 10, M=5, N=−4 and a comparison of both strands.

The BLAST algorithm also performs a statistical analysis of the similarity between two sequences (see, e.g., Karlin & Altschul, Proc. Natl. Acad. Sci. USA 90:5873, 1993). One measure of similarity provided by BLAST algorithm is the smallest sum probability (P(N)), which provides an indication of the probability by which a match between two nucleotide or amino acid sequences would occur by chance. For example, a nucleic acid is considered similar to a references sequence if the smallest sum probability in a comparison of the test nucleic acid to the reference nucleic acid is less than about 0.2, more preferably less than about 0.01 and most preferably less than about 0.001.

In one aspect, protein and nucleic acid sequence homologies are evaluated using the Basic Local Alignment Search Tool ("BLAST") In particular, five specific BLAST programs are used to perform the following task:

(1) BLASTP and BLAST3 compare an amino acid query sequence against a protein sequence database;

(2) BLASTN compares a nucleotide query sequence against a nucleotide sequence database;

(3) BLASTX compares the six-frame conceptual translation products of a query nucleotide sequence (both strands) against a protein sequence database;

(4) TBLASTN compares a query protein sequence against a nucleotide sequence database translated in all six reading frames (both strands); and (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., Science 256:1443-1445, 1992; Henikoff and Henikoff, Proteins 17:49-61, 1993). Less preferably, the PAM or PAM250 matrices may also be used (see, e.g., Schwartz and Dayhoff, eds., 1978, *Matrices for Detecting Distance Relationships: Atlas of Protein Sequence and Structure*, Washington: National Biomedical Research Foundation). BLAST programs are accessible through the U.S. National Library of Medicine.

The parameters used with the above algorithms may be adapted depending on the sequence length and degree of homology studied. In some aspects, the parameters may be the default parameters used by the algorithms in the absence of instructions from the user.

Computer Systems and Computer Program Products

To determine and identify sequence identities, structural homologies, motifs and the like in silico, a nucleic acid or polypeptide sequence of the invention can be stored, recorded, and manipulated on any medium which can be read and accessed by a computer.

Accordingly, the invention provides computers, computer systems, computer readable mediums, computer programs products and the like recorded or stored thereon the nucleic acid and polypeptide sequences of the invention. As used herein, the words "recorded" and "stored" refer to a process for storing information on a computer medium. A skilled artisan can readily adopt any known methods for recording information on a computer readable medium to generate manufactures comprising one or more of the nucleic acid and/or polypeptide sequences of the invention.

The polypeptides of the invention include the polypeptide sequences of Group B amino acid sequences, the exemplary sequences of the invention, and sequences substantially identical thereto, and fragments of any of the preceding sequences. Substantially identical, or homologous, polypeptide sequences refer to a polypeptide sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary sequence of the invention, e.g., a polypeptide sequences of the Group B amino acid sequences.

Homology may be determined using any of the computer programs and parameters described herein, including FASTA version 3.0t78 with the default parameters or with any modified parameters. The homologous sequences may be obtained using any of the procedures described herein or may result from the correction of a sequencing error. The polypeptide fragments comprise at least about 10, 15, 20, 25, 30, 35, 40, 45, 50, 75, 100, 150, 200, 250, 300, 350, 400, 450, 500 or more consecutive amino acids of the polypeptides of Group B amino acid sequences and sequences substantially identical thereto. It will be appreciated that the polypeptide codes as set forth in Group B amino acid sequences and sequences substantially identical thereto, can be represented in the traditional single character format or three letter format (See the inside back cover of Stryer, Lubert. *Biochemistry*, 3rd Ed., W. H Freeman & Co., New York.) or in any other format which relates the identity of the polypeptides in a sequence.

A nucleic acid or polypeptide sequence of the invention can be stored, recorded and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the nucleic acid sequences as set forth in Group A nucleic acid sequences and sequences substantially identical thereto, one or more of the polypeptide sequences as set forth in Group B amino acid sequences and sequences substantially identical thereto. Another aspect of the invention is a computer readable medium having recorded thereon at least 2, 5, 10, 15, or 20 or more nucleic acid sequences as set forth in Group A nucleic acid sequences and sequences substantially identical thereto.

Another aspect of the invention is a computer readable medium having recorded thereon one or more of the nucleic acid sequences as set forth in Group A nucleic acid sequences and sequences substantially identical thereto. Another aspect of the invention is a computer readable medium having recorded thereon one or more of the polypeptide sequences as set forth in Group B amino acid sequences and sequences substantially identical thereto. Another aspect of the invention is a computer readable medium having recorded thereon at least 2, 5, 10, 15, or 20 or more of the sequences as set forth above.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Aspects of the invention include systems (e.g., internet based systems), particularly computer systems which store and manipulate the sequence information described herein. One example of a computer system 100 is illustrated in block diagram form in FIG. 1. As used herein, "a computer system" refers to the hardware components, software components and data storage components used to analyze a nucleotide sequence of a nucleic acid sequence as set forth in Group A nucleic acid sequences and sequences substantially identical thereto, or a polypeptide sequence as set forth in the Group 1 amino acid sequences. The computer system 100 typically includes a processor for processing, accessing and manipulating the sequence data. The processor 105 can be any well-known type of central processing unit, such as, for example, the Pentium m from Intel Corporation, or similar processor from Sun, Motorola, Compaq, AMD or International Business Machines.

Typically the computer system 100 is a general purpose system that comprises the processor 105 and one or more internal data storage components 110 for storing data and one or more data retrieving devices for retrieving the data stored on the data storage components. A skilled artisan can readily appreciate that any one of the currently available computer systems are suitable.

In one particular aspect, the computer system 100 includes a processor 105 connected to a bus which is connected to a main memory 115 (preferably implemented as RAM) and one or more internal data storage devices 110, such as a hard drive and/or other computer readable media having data recorded thereon. In some aspects, the computer system 100 further includes one or more data retrieving device 118 for reading the data stored on the internal data storage devices 110.

The data retrieving device 118 may represent, for example, a floppy disk drive, a compact disk drive, a magnetic tape drive, or a modem capable of connection to a remote data storage system (e.g., via the internet) etc. In some aspects, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device.

The computer system 100 includes a display 120 which is used to display output to a computer user. It should also be noted that the computer system 100 can be linked to other computer systems 125a-c in a network or wide area network to provide centralized access to the computer system 100.

Software for accessing and processing the nucleotide sequences of a nucleic acid sequence as set forth in Group A nucleic acid sequences and sequences substantially identical thereto, or a polypeptide sequence as set forth in Group B amino acid sequences and sequences substantially identical thereto, (such as search tools, compare tools and modeling tools etc.) may reside in main memory 115 during execution.

In some aspects, the computer system 100 may further comprise a sequence comparison algorithm for comparing a nucleic acid sequence as set forth in Group A nucleic acid sequences and sequences substantially identical thereto, or a polypeptide sequence as set forth in Group B amino acid sequences and sequences substantially identical thereto, stored on a computer readable medium to a reference nucleotide or polypeptide sequence(s) stored on a computer readable medium. A "sequence comparison algorithm" refers to one or more programs which are implemented (locally or remotely) on the computer system 100 to compare a nucleotide sequence with other nucleotide sequences and/or compounds stored within a data storage means. For example, the sequence comparison algorithm may compare the nucleotide sequences of a nucleic acid sequence as set forth in Group A nucleic acid sequences and sequences substantially identical thereto, or a polypeptide sequence as set forth in Group B amino acid sequences and sequences substantially identical thereto, stored on a computer readable medium to reference sequences stored on a computer readable medium to identify homologies or structural motifs.

Figure 2:
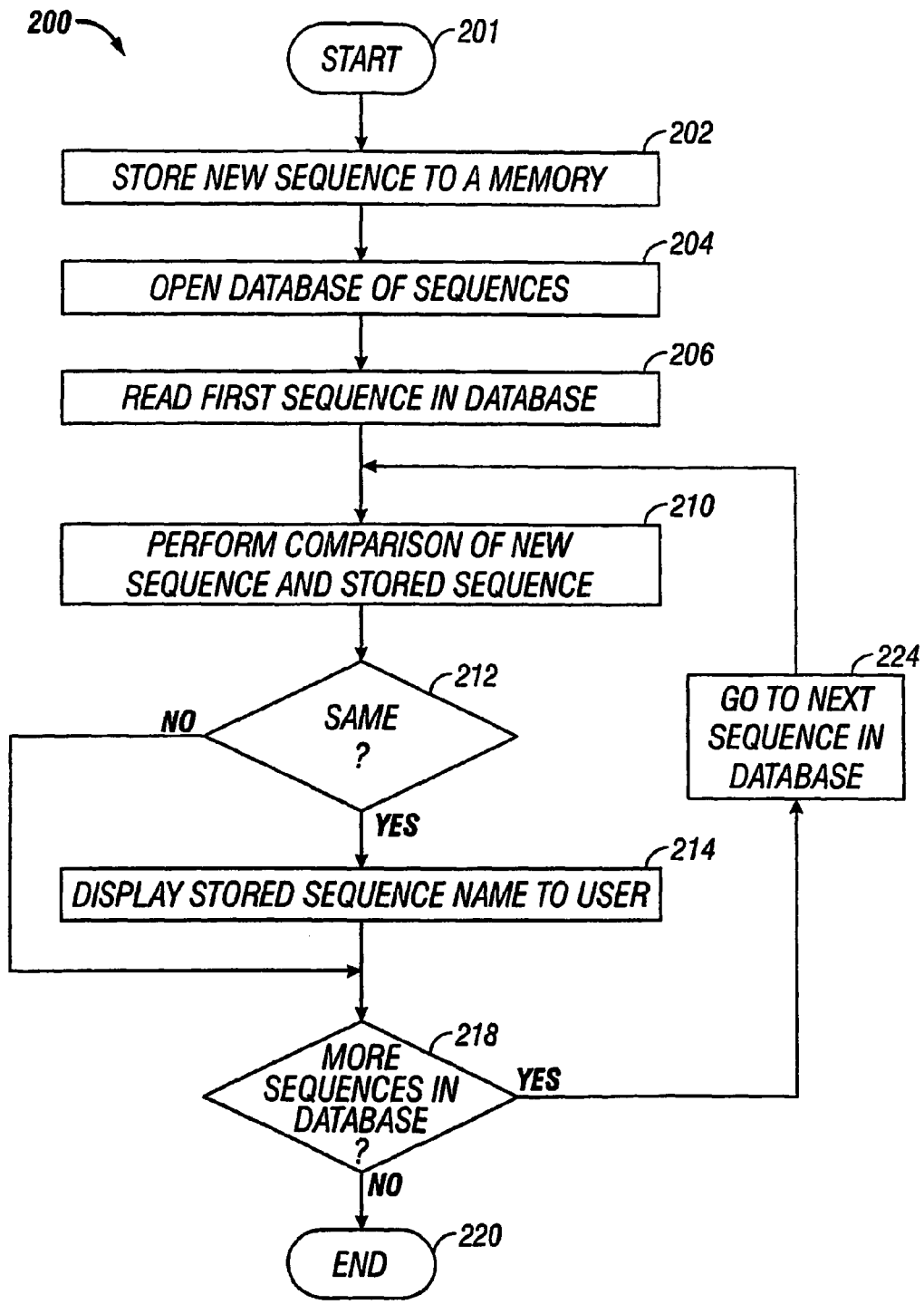
FIG. 2 is a flow diagram illustrating one aspect of a process for comparing a new nucleotide or protein sequence with a database of sequences in order to determine the homology levels between the new sequence and the sequences in the database.

FIG. 2 is a flow diagram illustrating one aspect of a process 200 for comparing a new nucleotide or protein sequence with a database of sequences in order to determine the homology levels between the new sequence and the sequences in the database. The database of sequences can be a private database stored within the computer system 100, or a public database such as GENBANK that is available through the Internet.

The process 200 begins at a start state 201 and then moves to a state 202 wherein the new sequence to be compared is stored to a memory in a computer system 100. As discussed above, the memory could be any type of memory, including RAM or an internal storage device.

The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200.

If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database.

It should be noted that if a determination had been made at the decision state 212 that the sequences were not homologous, then the process 200 would move immediately to the decision state 218 in order to determine if any other sequences were available in the database for comparison.

Accordingly, one aspect of the invention is a computer system comprising a processor, a data storage device having stored thereon a nucleic acid sequence as set forth in Group A nucleic acid sequences and sequences substantially identical thereto, or a polypeptide sequence as set forth in Group B amino acid sequences and sequences substantially identical thereto, a data storage device having retrievably stored thereon reference nucleotide sequences or polypeptide sequences to be compared to a nucleic acid sequence as set forth in Group A nucleic acid sequences and sequences substantially identical thereto, or a polypeptide sequence as set forth in Group B amino acid sequences and sequences substantially identical thereto and a sequence comparer for conducting the comparison. The sequence comparer may indicate a homology level between the sequences compared or identify structural motifs in the above described nucleic acid code of Group A nucleic acid sequences and sequences substantially identical thereto, or a polypeptide sequence as set forth in Group B amino acid sequences and sequences substantially identical thereto, or it may identify structural motifs in sequences which are compared to these nucleic acid codes and polypeptide codes. In some aspects, the data storage device may have stored thereon the sequences of at least 2, 5, 10, 15, 20, 25, 30 or 40 or more of the nucleic acid sequences as set forth in Group A nucleic acid sequences and sequences substantially identical thereto, or the polypeptide sequences as set forth in Group B amino acid sequences and sequences substantially identical thereto.

Another aspect of the invention is a method for determining the level of homology between a nucleic acid sequence as set forth in Group A nucleic acid sequences and sequences substantially identical thereto, or a polypeptide sequence as set forth in Group B amino acid sequences and sequences substantially identical thereto and a reference nucleotide sequence. The method including reading the nucleic acid code or the polypeptide code and the reference nucleotide or polypeptide sequence through the use of a computer program which determines homology levels and determining homology between the nucleic acid code or polypeptide code and the reference nucleotide or polypeptide sequence with the computer program. The computer program may be any of a number of computer programs for determining homology levels, including those specifically enumerated herein, (e.g. BLAST2N with the default parameters or with any modified parameters). The method may be implemented using the computer systems described above. The method may also be performed by reading at least 2, 5, 10, 15, 20, 25, 30 or 40 or more of the above described nucleic acid sequences as set forth in the Group A nucleic acid sequences, or the polypeptide sequences as set forth in the Group B amino acid sequences through use of the computer program and determining homology between the nucleic acid codes or polypeptide codes and reference nucleotide sequences or polypeptide sequences.

Figure 3:
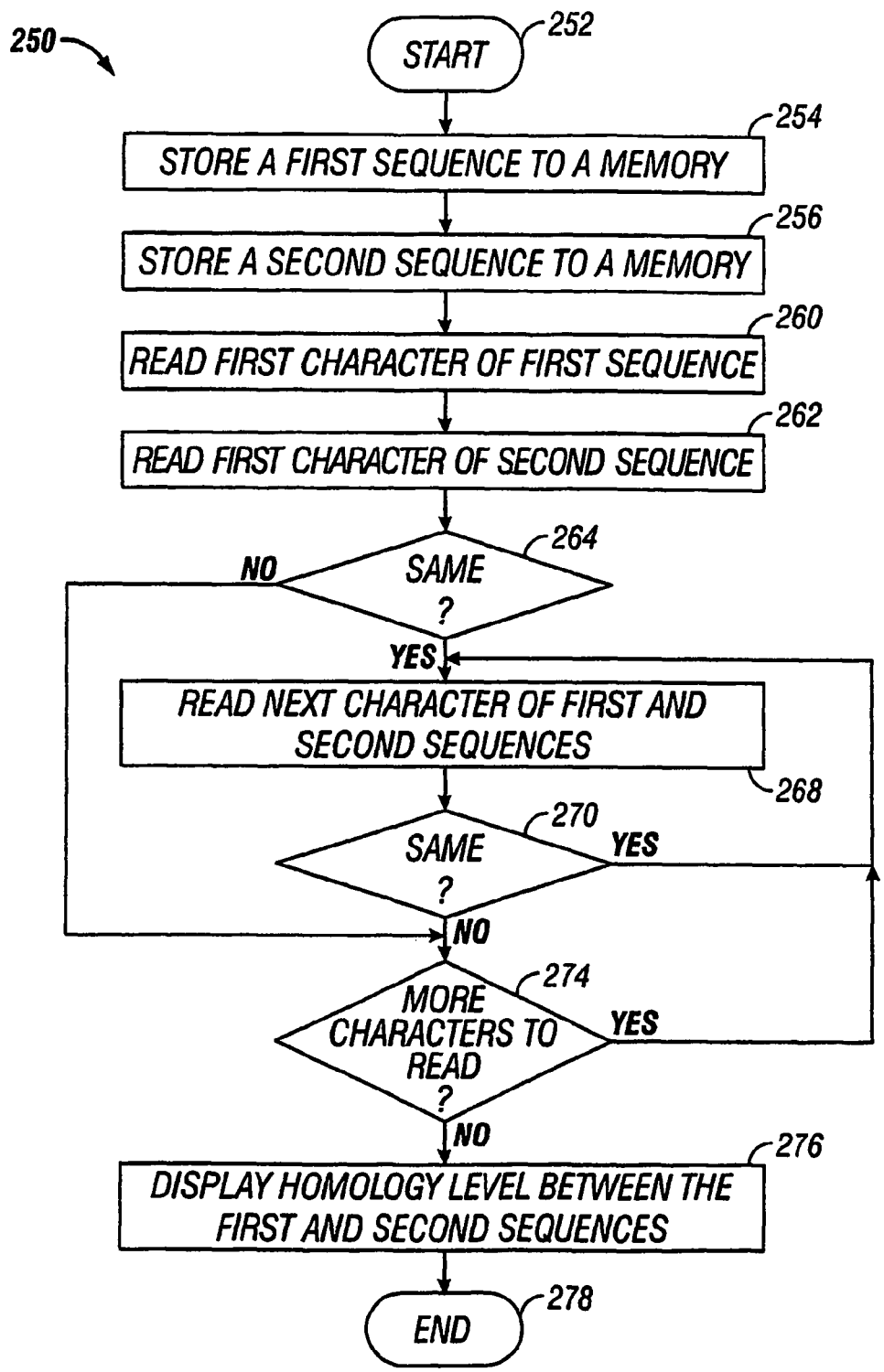
FIG. 3 is a flow diagram illustrating one aspect of a process in a computer for determining whether two sequences are homologous.

FIG. 3 is a flow diagram illustrating one aspect of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it is preferably in the single letter amino acid code so that the first and sequence sequences can be easily compared.

A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read.

If there are not any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of a nucleic acid sequence as set forth in the invention, to one or more reference nucleotide sequences in order to determine whether the nucleic acid code of Group A nucleic acid sequences and sequences substantially identical thereto, differs from a reference nucleic acid sequence at one or more positions. Optionally such a program records the length and identity of inserted, deleted or substituted nucleotides with respect to the sequence of either the reference polynucleotide or a nucleic acid sequence as set forth in Group A nucleic acid sequences and sequences substantially identical thereto. In one aspect, the computer program may be a program which determines whether a nucleic acid sequence as set forth in Group A nucleic acid sequences and sequences substantially identical thereto, contains a single nucleotide polymorphism (SNP) with respect to a reference nucleotide sequence.

Accordingly, another aspect of the invention is a method for determining whether a nucleic acid sequence as set forth in Group A nucleic acid sequences and sequences substantially identical thereto, differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some aspects, the computer program is a program which identifies single nucleotide polymorphisms. The method may be implemented by the computer systems described above and the method illustrated in FIG. 3. The method may also be performed by reading at least 2, 5, 10, 15, 20, 25, 30, or 40 or more of the nucleic acid sequences as set forth in Group A nucleic acid sequences and sequences substantially identical thereto and the reference nucleotide sequences through the use of the computer program and identifying differences between the nucleic acid codes and the reference nucleotide sequences with the computer program.

In other aspects the computer based system may further comprise an identifier for identifying features within a nucleic acid sequence as set forth in the Group A nucleic acid sequences or a polypeptide sequence as set forth in Group B amino acid sequences and sequences substantially identical thereto.

An "identifier" refers to one or more programs which identifies certain features within a nucleic acid sequence as set forth in Group A nucleic acid sequences and sequences substantially identical thereto, or a polypeptide sequence as set forth in Group B amino acid sequences and sequences substantially identical thereto. In one aspect, the identifier may comprise a program which identifies an open reading frame in a nucleic acid sequence as set forth in Group A nucleic acid sequences and sequences substantially identical thereto.

Figure 4:
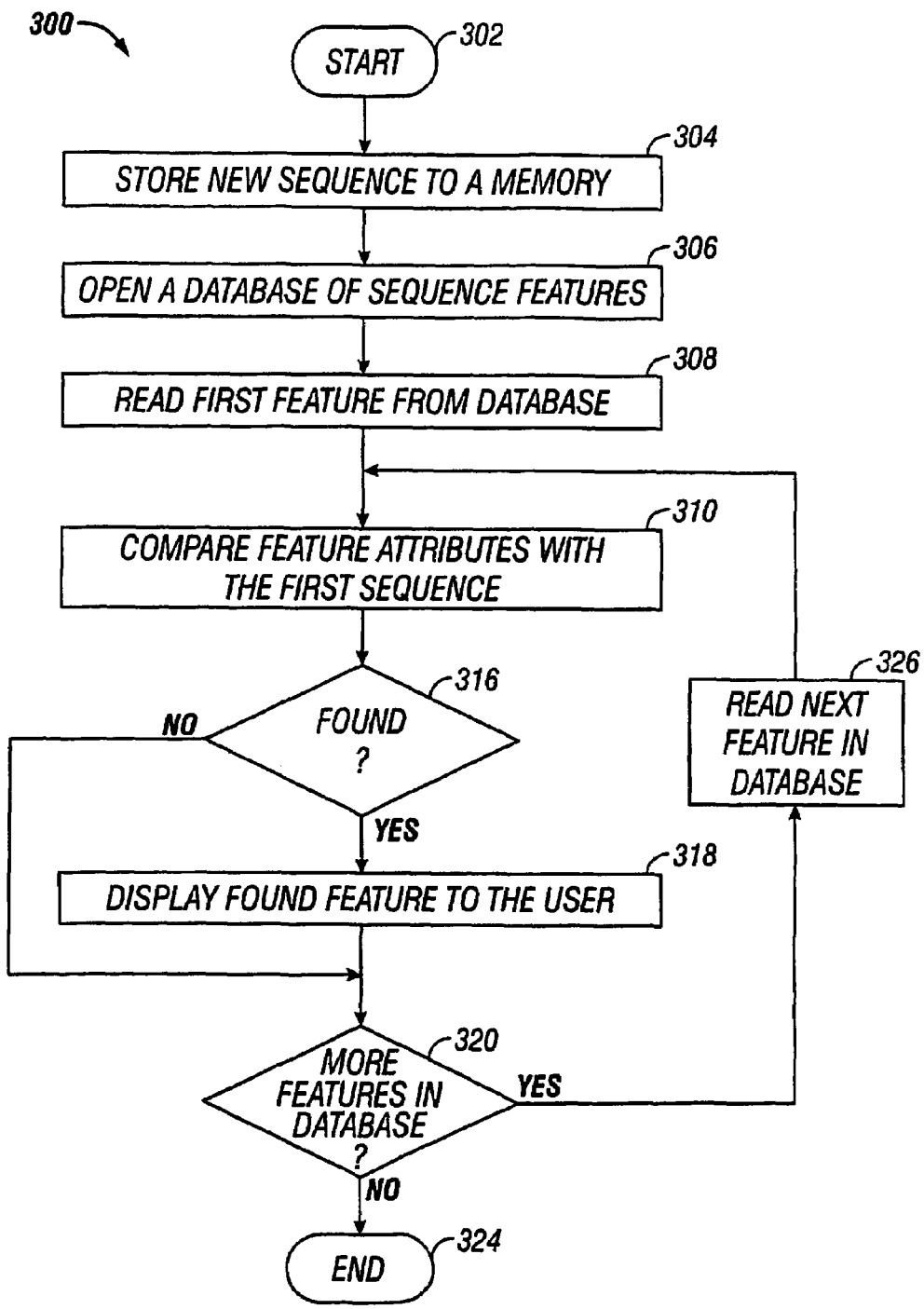
FIG. 4 is a flow diagram illustrating one aspect of an identifier process 300 for detecting the presence of a feature in a sequence.

FIG. 4 is a flow diagram illustrating one aspect of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group. Alternatively, the features may be structural polypeptide motifs such as alpha helices, beta sheets, or functional polypeptide motifs such as enzymatic active sites, helix-turn-helix motifs or other motifs known to those skilled in the art.

Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user.

The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence. It should be noted, that if the feature attribute is not found in the first sequence at the decision state 316, the process 300 moves directly to the decision state 320 in order to determine if any more features exist in the database.

Accordingly, another aspect of the invention is a method of identifying a feature within a nucleic acid sequence as set forth in Group A nucleic acid sequences and sequences substantially identical thereto, or a polypeptide sequence as set forth in Group B amino acid sequences and sequences substantially identical thereto, comprising reading the nucleic acid code(s) or polypeptide code(s) through the use of a computer program which identifies features therein and identifying features within the nucleic acid code(s) with the computer program. In one aspect, computer program comprises a computer program which identifies open reading frames. The method may be performed by reading a single sequence or at least 2, 5, 10, 15, 20, 25, 30, or 40 of the nucleic acid sequences as set forth in Group A nucleic acid sequences and sequences substantially identical thereto, or the polypeptide sequences as set forth in Group B amino acid sequences and sequences substantially identical thereto, through the use of the computer program and identifying features within the nucleic acid codes or polypeptide codes with the computer program.

A nucleic acid sequence as set forth in Group A nucleic acid sequences and sequences substantially identical thereto, or a polypeptide sequence as set forth in Group B amino acid sequences and sequences substantially identical thereto, may be stored and manipulated in a variety of data processor programs in a variety of formats. For example, a nucleic acid sequence as set forth in Group A nucleic acid sequences and sequences substantially identical thereto, or a polypeptide sequence as set forth in Group B amino acid sequences and sequences substantially identical thereto, may be stored as text in a word processing file, such as Microsoft WORD™ or WORDPERFECT™ or as an ASCII file in a variety of database programs familiar to those of skill in the art, such as DB2™, SYBASE™, or ORACLE™. In addition, many computer programs and databases may be used as sequence comparison algorithms, identifiers, or sources of reference nucleotide sequences or polypeptide sequences to be compared to a nucleic acid sequence as set forth in Group A nucleic acid sequences and sequences substantially identical thereto, or a polypeptide sequence as set forth in Group B amino acid sequences and sequences substantially identical thereto. The following list is intended not to limit the invention but to provide guidance to programs and databases which are useful with the nucleic acid sequences as set forth in Group A nucleic acid sequences and sequences substantially identical thereto, or the polypeptide sequences as set forth in Group B amino acid sequences and sequences substantially identical thereto.

The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, J. Mol. Biol. 215: 403, 1990), FASTA (Pearson and Lipman, Proc. Natl. Acad. Sci. USA, 85: 2444, 1988), FASTDB (Brutlag et al. Comp. App. Biosci. 6:237-245, 1990), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the MDL Available Chemicals Directory database, the MDL Drug Data Report data base, the Comprehensive Medicinal Chemistry database, Derwents's World Drug Index database, the BioByteMasterFile database, the Genbank database and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices and beta sheets, signal sequences encoding signal peptides which direct the secretion of the encoded proteins, sequences implicated in transcription regulation such as homeoboxes, acidic stretches, enzymatic active sites, substrate binding sites and enzymatic cleavage sites.

Hybridization of Nucleic Acids

The invention provides isolated or recombinant nucleic acids that hybridize under stringent conditions to an exemplary sequence of the invention (e.g., SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ D NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:11, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:199, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, SEQ ID NO:321, SEQ ID NO:323, SEQ ID NO:325, SEQ ID NO:327, SEQ ID NO:329, SEQ ID NO:331, SEQ ID NO:333, SEQ ID NO:335, SEQ ID NO:337, SEQ ID NO:339, SEQ ID NO:341, SEQ ID NO:343, SEQ ID NO:345, SEQ ID NO:347, SEQ ID NO:349, SEQ ID NO:351, SEQ ID NO:353, SEQ ID NO:355, SEQ ID NO:357, SEQ ID NO:359, SEQ ID NO:361, SEQ ID NO:363, SEQ ID NO:365, SEQ ID NO:367, SEQ ID NO:369, SEQ ID NO:371, SEQ ID NO:373, SEQ ID NO:375, SEQ ID NO:377 or SEQ ID NO:379). The stringent conditions can be highly stringent conditions, medium stringent conditions and/or low stringent conditions, including the high and reduced stringency conditions described herein. In one aspect, it is the stringency of the wash conditions that set forth the conditions which determine whether a nucleic acid is within the scope of the invention, as discussed below.

In alternative aspects, nucleic acids of the invention as defined by their ability to hybridize under stringent conditions can be between about five residues and the full length of nucleic acid of the invention; e.g., they can be at least 5, 10, 15, 20, 25, 30, 35, 40, 50, 55, 60, 65, 70, 75, 80, 90, 100, 150, 200, 250, 300, 350, 400, 450, 500, 550, 600, 650, 700, 750, 800, 850, 900, 950, 1000, or more, residues in length. Nucleic acids shorter than full length are also included. These nucleic acids can be useful as, e.g., hybridization probes, labeling probes, PCR oligonucleotide probes, iRNA (single or double stranded), antisense or sequences encoding antibody binding peptides (epitopes), motifs, active sites and the like.

In one aspect, nucleic acids of the invention are defined by their ability to hybridize under high stringency comprises conditions of about 50% formamide at about 37° C. to 42° C. In one aspect, nucleic acids of the invention are defined by their ability to hybridize under reduced stringency comprising conditions in about 35% to 25% formamide at about 30° C. to 35° C.

Alternatively, nucleic acids of the invention are defined by their ability to hybridize under high stringency comprising conditions at 42° C. in 50% formamide, 5× SSPE, 0.3% SDS, and a repetitive sequence blocking nucleic acid, such as cot-1 or salmon sperm DNA (e.g., 200 n/ml sheared and denatured salmon sperm DNA). In one aspect, nucleic acids of the invention are defined by their ability to hybridize under reduced stringency conditions comprising 35% formamide at a reduced temperature of 35° C.

In nucleic acid hybridization reactions, the conditions used to achieve a particular level of stringency will vary, depending on the nature of the nucleic acids being hybridized. For example, the length, degree of complementarity, nucleotide sequence composition (e.g., GC v. AT content) and nucleic acid type (e.g. RNA v. DNA) of the hybridizing regions of the nucleic acids can be considered in selecting hybridization conditions. An additional consideration is whether one of the nucleic acids is immobilized, for example, on a filter.

Hybridization may be carried out under conditions of low stringency, moderate stringency or high stringency. As an example of nucleic acid hybridization, a polymer membrane containing immobilized denatured nucleic acids is first prehybridized for 30 minutes at 45° C. in a solution consisting of 0.9 M NaCl, 50 mM $NaH_2PO_4$, pH 7.0, 5.0 mM $Na_2EDTA$, 0.5% SDS, 10× Denhardt's and 0.5 mg/ml polyriboadenylic acid. Approximately $2 \times 10^7$ cpm (specific activity $4-9 \times 10^8$ cpm/ug) of $^{32}P$ end-labeled oligonucleotide probe are then added to the solution. After 12-16 hours of incubation, the membrane is washed for 30 minutes at room temperature in 1× SET (150 mM NaCl, 20 mM Tris hydrochloride, pH 7.8, 1 mM $Na_2EDTA$) containing 0.5% SDS, followed by a 30 minute wash in fresh 1×SET at $T_m$-10° C. for the oligonucleotide probe. The membrane is then exposed to auto-radiographic film for detection of hybridization signals.

All of the foregoing hybridizations would be considered to be under conditions of high stringency.

Following hybridization, a filter can be washed to remove any non-specifically bound detectable probe. The stringency used to wash the filters can also be varied depending on the nature of the nucleic acids being hybridized, the length of the nucleic acids being hybridized, the degree of complementarity, the nucleotide sequence composition (e.g., GC v. AT content) and the nucleic acid type (e.g., RNA v. DNA). Examples of progressively higher stringency condition washes are as follows: 2×SSC, 0.1% SDS at room temperature for 15 minutes (low stringency); 0.1×SSC, 0.5% SDS at room temperature for 30 minutes to 1 hour (moderate stringency); 0.1×SSC, 0.5% SDS for 15 to 30 minutes at between the hybridization temperature and 68° C. (high stringency); and 0.15M NaCl for 15 minutes at 72° C. (very high stringency). A final low stringency wash can be conducted in 0.1×SSC at room temperature. The examples above are merely illustrative of one set of conditions that can be used to wash filters. One of skill in the art would know that there are numerous recipes for different stringency washes. Some other examples are given below.

Nucleic acids which have hybridized to the probe are identified by autoradiography or other conventional techniques.

The above procedure may be modified to identify nucleic acids having decreasing levels of homology to the probe sequence. For example, to obtain nucleic acids of decreasing homology to the detectable probe, less stringent conditions may be used. For example, the hybridization temperature may be decreased in increments of 5° C. from 68° C. to 42° C. in a hybridization buffer having a Na+ concentration of approximately 1M. Following hybridization, the filter may be washed with 2×SSC, 0.5% SDS at the temperature of hybridization. These conditions are considered to be "moderate" conditions above 50° C. and "low" conditions below 50° C. A specific example of "moderate" hybridization conditions is when the above hybridization is conducted at 55° C. A specific example of "low stringency" hybridization conditions is when the above hybridization is conducted at 45° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

However, the selection of a hybridization format is not critical—it is the stringency of the wash conditions that set forth the conditions which determine whether a nucleic acid is within the scope of the invention. Wash conditions used to identify nucleic acids within the scope of the invention include, e.g.: a salt concentration of about 0.02 molar at pH 7 and a temperature of at least about 50° C. or about 55° C. to about 60° C.; or, a salt concentration of about 0.15 M NaCl at 72° C. for about 15 minutes; or, a salt concentration of about 0.2×SSC at a temperature of at least about 50° C. or about 55° C. to about 60° C. for about 15 to about 20 minutes; or, the hybridization complex is washed twice with a solution with a salt concentration of about 2×SSC containing 0.1% SDS at room temperature for 15 minutes and then washed twice by 0.1×SSC containing 0.1% SDS at 68° C. for 15 minutes; or, equivalent conditions. See Sambrook, Tijssen and Ausubel for a description of SSC buffer and equivalent conditions.

These methods may be used to isolate nucleic acids of the invention. For example, the preceding methods may be used to isolate nucleic acids having a sequence with at least about 97%, at least 95%, at least 90%, at least 85%, at least 80%, at least 75%, at least 70%, at least 65%, at least 60%, at least 55%, or at least 50% homology to a nucleic acid sequence selected from the group consisting of one of the sequences of Group A nucleic acid sequences and sequences substantially identical thereto, or fragments comprising at least about 10, 15, 20, 25, 30, 35, 40, 50, 75, 100, 150, 200, 300, 400, or 500 consecutive bases thereof and the sequences complementary thereto. Homology may be measured using the alignment algorithm. For example, the homologous polynucleotides may have a coding sequence which is a naturally occurring allelic variant of one of the coding sequences described herein. Such allelic variants may have a substitution, deletion or addition of one or more nucleotides when compared to the nucleic acids of Group A nucleic acid sequences or the sequences complementary thereto.

Additionally, the above procedures may be used to isolate nucleic acids which encode polypeptides having at least about 99%, 95%, at least 90%, at least 85%, at least 80%, at least 75%, at least 70%, at least 65%, at least 60%, at least 55%, or at least 50% homology to a polypeptide having the sequence of one of Group B amino acid sequences and sequences substantially identical thereto, or fragments comprising at least 5, 10, 15, 20, 25, 30, 35, 40, 50, 75, 100, or 150 consecutive amino acids thereof as determined using a sequence alignment algorithm (e.g., such as the FASTA version 3.0t78 algorithm with the default parameters).

Oligonucleotides Probes and Methods for Using them

The invention also provides nucleic acid probes that can be used, e.g., for identifying nucleic acids encoding a polypeptide with a xylanase activity or fragments thereof or for identifying xylanase genes. In one aspect, the probe comprises at least 10 consecutive bases of a nucleic acid of the invention. Alternatively, a probe of the invention can be at least about 5, 6, 7, 8, 9, 10, 11, 12, 13, 14, 15, 16, 17, 18, 19, 20, 21, 22, 23, 24, 25, 30, 35, 40, 45, 50, 60, 70, 80, 90, 100, 110, 120, 130, 150 or about 10 to 50, about 20 to 60 about 30 to 70, consecutive bases of a sequence as set forth in a nucleic acid of the invention. The probes identify a nucleic acid by binding and/or hybridization. The probes can be used in arrays of the invention, see discussion below, including, e.g., capillary arrays. The probes of the invention can also be used to isolate other nucleic acids or polypeptides.

The isolated nucleic acids of Group A nucleic acid sequences and sequences substantially identical thereto, the sequences complementary thereto, or a fragment comprising at least 10, 15, 20, 25, 30, 35, 40, 50, 75, 100, 150, 200, 300, 400, or 500 consecutive bases of one of the sequences of Group A nucleic acid sequences and sequences substantially identical thereto, or the sequences complementary thereto may also be used as probes to determine whether a biological sample, such as a soil sample, contains an organism having a nucleic acid sequence of the invention or an organism from which the nucleic acid was obtained. In such procedures, a biological sample potentially harboring the organism from which the nucleic acid was isolated is obtained and nucleic acids are obtained from the sample. The nucleic acids are contacted with the probe under conditions which permit the probe to specifically hybridize to any complementary sequences from which are present therein.

Where necessary, conditions which permit the probe to specifically hybridize to complementary sequences may be determined by placing the probe in contact with complementary sequences from samples known to contain the complementary sequence as well as control sequences which do not contain the complementary sequence. Hybridization conditions, such as the salt concentration of the hybridization buffer, the formamide concentration of the hybridization buffer, or the hybridization temperature, may be varied to identify conditions which allow the probe to hybridize specifically to complementary nucleic acids.

If the sample contains the organism from which the nucleic acid was isolated, specific hybridization of the probe is then detected. Hybridization may be detected by labeling the probe with a detectable agent such as a radioactive isotope, a fluorescent dye or an enzyme capable of catalyzing the formation of a detectable product.

Many methods for using the labeled probes to detect the presence of complementary nucleic acids in a sample are familiar to those skilled in the art. These include Southern Blots, Northern Blots, colony hybridization procedures and dot blots. Protocols for each of these procedures are provided in Ausubel et al. *Current Protocols in Molecular Biology*, John Wiley 503 Sons, Inc. (1997) and Sambrook et al., *Molecular Cloning: A Laboratory Manual 2nd Ed.*, Cold Spring Harbor Laboratory Press (1989.

Alternatively, more than one probe (at least one of which is capable of specifically hybridizing to any complementary sequences which are present in the nucleic acid sample), may be used in an amplification reaction to determine whether the sample contains an organism containing a nucleic acid sequence of the invention (e.g., an organism from which the nucleic acid was isolated). Typically, the probes comprise oligonucleotides. In one aspect, the amplification reaction may comprise a PCR reaction. PCR protocols are described in Ausubel and Sambrook, supra. Alternatively, the amplification may comprise a ligase chain reaction, 3SR, or strand displacement reaction. (See Barany, F., "The Ligase Chain Reaction in a PCR World", *PCR Methods and Applications* 1:5-16, 1991; E. Fahy et al., "Self-sustained Sequence Replication (3SR): An Isothermal Transcription-based Amplification System Alternative to PCR", *PCR Methods and Applications* 1:25-33, 1991; and Walker G. T. et al., "Strand Displacement Amplification-an Isothermal in vitro DNA Amplification Technique", *Nucleic Acid Research* 20:1691-1696, 1992). In such procedures, the nucleic acids in the sample are contacted with the probes, the amplification reaction is performed and any resulting amplification product is detected. The amplification product may be detected by performing gel electrophoresis on the reaction products and staining the gel with an intercalator such as ethidium bromide. Alternatively, one or more of the probes may be labeled with a radioactive isotope and the presence of a radioactive amplification product may be detected by autoradiography after gel electrophoresis.

Probes derived from sequences near the ends of the sequences of Group A nucleic acid sequences and sequences substantially identical thereto, may also be used in chromosome walking procedures to identify clones containing genomic sequences located adjacent to the sequences of Group A nucleic acid sequences and sequences substantially identical thereto. Such methods allow the isolation of genes which encode additional proteins from the host organism.

The isolated nucleic acids of Group A nucleic acid sequences and sequences substantially identical thereto, the sequences complementary thereto, or a fragment comprising at least 10, 15, 20, 25, 30, 35, 40, 50, 75, 100, 150, 200, 300, 400, or 500 consecutive bases of one of the sequences of Group A nucleic acid sequences and sequences substantially identical thereto, or the sequences complementary thereto may be used as probes to identify and isolate related nucleic acids. In some aspects, the related nucleic acids may be cDNAs or genomic DNAs from organisms other than the one from which the nucleic acid was isolated. For example, the other organisms may be related organisms. In such procedures, a nucleic acid sample is contacted with the probe under conditions which permit the probe to specifically hybridize to related sequences. Hybridization of the probe to nucleic acids from the related organism is then detected using any of the methods described above.

By varying the stringency of the hybridization conditions used to identify nucleic acids, such as cDNAs or genomic DNAs, which hybridize to the detectable probe, nucleic acids having different levels of homology to the probe can be identified and isolated. Stringency may be varied by conducting the hybridization at varying temperatures below the melting temperatures of the probes. The melting temperature, $T_m$, is the temperature (under defined ionic strength and pH) at which 50% of the target sequence hybridizes to a perfectly complementary probe. Very stringent conditions are selected to be equal to or about 5° C. lower than the $T_m$ for a particular probe. The melting temperature of the probe may be calculated using the following formulas:

For probes between 14 and 70 nucleotides in length the melting temperature ($T_m$) is calculated using the formula: $T_m=81.5+16.6(\log\ [Na+])+0.41(\text{fraction}\ G+C)-(600/N)$ where N is the length of the probe.

If the hybridization is carried out in a solution containing formamide, the melting temperature may be calculated using the equation: $T_m=81.5+16.6(\log\ [Na+])+0.41(\text{fraction}\ G+C)-(0.63\%\ \text{formamide})-(600/N)$ where N is the length of the probe.

Prehybridization may be carried out in 6×SSC, 5× Denhardt's reagent, 0.5% SDS, 100 µg denatured fragmented salmon sperm DNA or 6×SSC, 5× Denhardt's reagent, 0.5% SDS, 100 µg denatured fragmented salmon sperm DNA, 50% formamide. The formulas for SSC and Denhardt's solutions are listed in Sambrook et al., supra.

Hybridization is conducted by adding the detectable probe to the prehybridization solutions listed above. Where the probe comprises double stranded DNA, it is denatured before addition to the hybridization solution. The filter is contacted with the hybridization solution for a sufficient period of time to allow the probe to hybridize to cDNAs or genomic DNAs containing sequences complementary thereto or homologous thereto. For probes over 200 nucleotides in length, the hybridization may be carried out at 15-25° C. below the $T_m$. For shorter probes, such as oligonucleotide probes, the hybridization may be conducted at 5-10° C. below the $T_m$. Typically, for hybridizations in 6×SSC, the hybridization is conducted at approximately 68° C. Usually, for hybridizations in 50% formamide containing solutions, the hybridization is conducted at approximately 42° C.

Inhibiting Expression of Xylanases

The invention provides nucleic acids complementary to (e.g., antisense sequences to) the nucleic acids of the invention, e.g., xylanase-encoding nucleic acids. Antisense sequences are capable of inhibiting the transport, splicing or transcription of xylanase-encoding genes. The inhibition can be effected through the targeting of genomic DNA or messenger RNA. The transcription or function of targeted nucleic acid can be inhibited, for example, by hybridization and/or cleavage. One particularly useful set of inhibitors provided by the present invention includes oligonucleotides which are able to either bind xylanase gene or message, in either case preventing or inhibiting the production or function of xylanase. The association can be through sequence specific hybridization. Another useful class of inhibitors includes oligonucleotides which cause inactivation or cleavage of xylanase message. The oligonucleotide can have enzyme activity which causes such cleavage, such as ribozymes. The oligonucleotide can be chemically modified or conjugated to an enzyme or composition capable of cleaving the complementary nucleic acid. A pool of many different such oligonucleotides can be screened for those with the desired activity. Thus, the invention provides various compositions for the inhibition of xylanase expression on a nucleic acid and/or protein level, e.g., antisense, iRNA and ribozymes comprising xylanase sequences of the invention and the anti-xylanase antibodies of the invention.

Inhibition of xylanase expression can have a variety of industrial applications. For example, inhibition of xylanase expression can slow or prevent spoilage. Spoilage can occur when polysaccharides, e.g., structural polysaccharides, are enzymatically degraded. This can lead to the deterioration, or rot, of fruits and vegetables. In one aspect, use of compositions of the invention that inhibit the expression and/or activity of xylanases, e.g., antibodies, antisense oligonucleotides, ribozymes and RNAi, are used to slow or prevent spoilage. Thus, in one aspect, the invention provides methods and compositions comprising application onto a plant or plant product (e.g., a cereal, a grain, a fruit, seed, root, leaf, etc.) antibodies, antisense oligonucleotides, ribozymes and RNAi of the invention to slow or prevent spoilage. These compositions also can be expressed by the plant (e.g., a transgenic plant) or another organism (e.g., a bacterium or other microorganism transformed with a xylanase gene of the invention).

The compositions of the invention for the inhibition of xylanase expression (e.g., antisense, iRNA, ribozymes, antibodies) can be used as pharmaceutical compositions, e.g., as anti-pathogen agents or in other therapies, e.g., as anti-microbials for, e.g., *Salmonella*.

Antisense Oligonucleotides

The invention provides antisense oligonucleotides capable of binding xylanase message which can inhibit xylan hydrolase activity (e.g., catalyzing hydrolysis of internal β-1,4-xylosidic linkages) by targeting mRNA. Strategies for designing antisense oligonucleotides are well described in the scientific and patent literature, and the skilled artisan can design such xylanase oligonucleotides using the novel reagents of the invention. For example, gene walking/RNA mapping protocols to screen for effective antisense oligonucleotides are well known in the art, see, e.g., Ho (2000) Methods Enzymol. 314:168-183, describing an RNA mapping assay, which is based on standard molecular techniques to provide an easy and reliable method for potent antisense sequence selection. See also Smith (2000) Eur. J. Pharm. Sci. 11:191-198.

Naturally occurring nucleic acids are used as antisense oligonucleotides. The antisense oligonucleotides can be of any length; for example, in alternative aspects, the antisense oligonucleotides are between about 5 to 100, about 10 to 80, about 15 to 60, about 18 to 40. The optimal length can be determined by routine screening. The antisense oligonucleotides can be present at any concentration. The optimal concentration can be determined by routine screening. A wide variety of synthetic, non-naturally occurring nucleotide and nucleic acid analogues are known which can address this potential problem. For example, peptide nucleic acids (PNAs) containing non-ionic backbones, such as N-(2-aminoethyl) glycine units can be used. Antisense oligonucleotides having phosphorothioate linkages can also be used, as described in WO 97/03211; WO 96/39154; Mata (1997) Toxicol Appl Pharmacol 144:189-197; Antisense Therapeutics, ed. Agrawal (Humana Press, Totowa, N.J., 1996). Antisense oligonucleotides having synthetic DNA backbone analogues provided by the invention can also include phosphorodithioate, methylphosphonate, phosphoramidate, alkyl phosphotriester, sulfamate, 3'-thioacetal, methylene(methylimino), 3'-N-carbamate, and morpholino carbamate nucleic acids, as described above.

Combinatorial chemistry methodology can be used to create vast numbers of oligonucleotides that can be rapidly screened for specific oligonucleotides that have appropriate binding affinities and specificities toward any target, such as the sense and antisense xylanase sequences of the invention (see, e.g., Gold (1995) J. of Biol. Chem. 270:13581-13584).

Inhibitory Ribozymes

The invention provides ribozymes capable of binding xylanase message. These ribozymes can inhibit xylanase activity by, e.g., targeting mRNA. Strategies for designing ribozymes and selecting the xylanase-specific antisense sequence for targeting are well described in the scientific and patent literature, and the skilled artisan can design such ribozymes using the novel reagents of the invention. Ribozymes act by binding to a target RNA through the target RNA binding portion of a ribozyme which is held in close proximity to an enzymatic portion of the RNA that cleaves the target RNA. Thus, the ribozyme recognizes and binds a target RNA through complementary base-pairing, and once bound to the correct site, acts enzymatically to cleave and inactivate the target RNA. Cleavage of a target RNA in such a manner will destroy its ability to direct synthesis of an encoded protein if the cleavage occurs in the coding sequence. After a ribozyme has bound and cleaved its RNA target, it can be released from that RNA to bind and cleave new targets repeatedly.

In some circumstances, the enzymatic nature of a ribozyme can be advantageous over other technologies, such as antisense technology (where a nucleic acid molecule simply binds to a nucleic acid target to block its transcription, translation or association with another molecule) as the effective concentration of ribozyme necessary to effect a therapeutic treatment can be lower than that of an antisense oligonucleotide. This potential advantage reflects the ability of the ribozyme to act enzymatically. Thus, a single ribozyme molecule is able to cleave many molecules of target RNA. In addition, a ribozyme is typically a highly specific inhibitor, with the specificity of inhibition depending not only on the base pairing mechanism of binding, but also on the mechanism by which the molecule inhibits the expression of the RNA to which it binds. That is, the inhibition is caused by cleavage of the RNA target and so specificity is defined as the ratio of the rate of cleavage of the targeted RNA over the rate of cleavage of non-targeted RNA. This cleavage mechanism is dependent upon factors additional to those involved in base pairing. Thus, the specificity of action of a ribozyme can be greater than that of antisense oligonucleotide binding the same RNA site.

The ribozyme of the invention, e.g., an enzymatic ribozyme RNA molecule, can be formed in a hammerhead motif, a hairpin motif, as a hepatitis delta virus motif, a group I intron motif and/or an RNaseP-like RNA in association with an RNA guide sequence. Examples of hammerhead motifs are described by, e.g., Rossi (1992) Aids Research and Human Retroviruses 8:183; hairpin motifs by Hampel (1989) Biochemistry 28:4929, and Hampel (1990) Nuc. Acids Res. 18:299; the hepatitis delta virus motif by Perrotta (1992) Biochemistry 31:16; the RNaseP motif by Guerrier-Takada (1983) Cell 35:849; and the group I intron by Cech U.S. Pat. No. 4,987,071. The recitation of these specific motifs is not intended to be limiting. Those skilled in the art will recognize that a ribozyme of the invention, e.g., an enzymatic RNA molecule of this invention, can have a specific substrate binding site complementary to one or more of the target gene RNA regions. A ribozyme of the invention can have a nucleotide sequence within or surrounding that substrate binding site which imparts an RNA cleaving activity to the molecule.

RNA Interference (RNAi)

In one aspect, the invention provides an RNA inhibitory molecule, a so-called "RNAi" molecule, comprising a xylanase sequence of the invention. The RNAi molecule comprises a double-stranded RNA (dsRNA) molecule. The RNAi can inhibit expression of a xylanase gene. In one aspect, the RNAi is about 15, 16, 17, 18, 19, 20, 21, 22, 23, 24, 25 or more duplex nucleotides in length. While the invention is not limited by any particular mechanism of action, the RNAi can enter a cell and cause the degradation of a single-stranded RNA (ssRNA) of similar or identical sequences, including endogenous mRNAs. When a cell is exposed to double-stranded RNA (dsRNA), mRNA from the homologous gene is selectively degraded by a process called RNA interference (RNAi). A possible basic mechanism behind RNAi is the breaking of a double-stranded RNA (dsRNA) matching a specific gene sequence into short pieces called short interfering RNA, which trigger the degradation of mRNA that matches its sequence. In one aspect, the RNAi's of the invention are used in gene-silencing therapeutics, see, e.g., Shuey (2002) Drug Discov. Today 7:1040-1046. In one aspect, the invention provides methods to selectively degrade RNA using the RNAi's of the invention. The process may be practiced in vitro, ex vivo or in vivo. In one aspect, the RNAi molecules of the invention can be used to generate a loss-of-function mutation in a cell, an organ or an animal. Methods for making and using RNAi molecules for selectively degrade RNA are well known in the art, see, e.g., U.S. Pat. Nos. 6,506,559; 6,511,824; 6,515,109; 6,489,127.

Modification of Nucleic Acids

The invention provides methods of generating variants of the nucleic acids of the invention, e.g., those encoding a xylanase. These methods can be repeated or used in various combinations to generate xylanases having an altered or different activity or an altered or different stability from that of a xylanase encoded by the template nucleic acid. These methods also can be repeated or used in various combinations, e.g., to generate variations in gene/message expression, message translation or message stability. In another aspect, the genetic composition of a cell is altered by, e.g., modification of a homologous gene ex vivo, followed by its reinsertion into the cell.

A nucleic acid of the invention can be altered by any means. For example, random or stochastic methods, or, non-stochastic, or "directed evolution," methods, see, e.g., U.S. Pat. No. 6,361,974. Methods for random mutation of genes are well known in the art, see, e.g., U.S. Pat. No. 5,830,696. For example, mutagens can be used to randomly mutate a gene. Mutagens include, e.g., ultraviolet light or gamma irradiation, or a chemical mutagen, e.g., mitomycin, nitrous acid, photo-activated psoralens, alone or in combination, to induce DNA breaks amenable to repair by recombination. Other chemical mutagens include, for example, sodium bisulfite, nitrous acid, hydroxylamine, hydrazine or formic acid. Other mutagens are analogues of nucleotide precursors, e.g., nitrosoguanidine, 5-bromouracil, 2-aminopurine, or acridine. These agents can be added to a PCR reaction in place of the nucleotide precursor thereby mutating the sequence. Intercalating agents such as proflavine, acriflavine, quinacrine and the like can also be used.

Any technique in molecular biology can be used, e.g., random PCR mutagenesis, see, e.g., Rice (1992) Proc. Natl. Acad. Sci. USA 89:5467-5471; or, combinatorial multiple cassette mutagenesis, see, e.g., Crameri (1995) Biotechniques 18:194-196. Alternatively, nucleic acids, e.g., genes, can be reassembled after random, or "stochastic," fragmentation, see, e.g., U.S. Pat. Nos. 6,291,242; 6,287,862; 6,287,861; 5,955,358; 5,830,721; 5,824,514; 5,811,238; 5,605,793. In alternative aspects, modifications, additions or deletions are introduced by error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly (e.g., GeneReassembly™, see, e.g., U.S. Pat. No. 6,537,776), gene site saturated mutagenesis (GSSM™), synthetic ligation reassembly (SLR), recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation, and/or a combination of these and other methods.

The following publications describe a variety of recursive recombination procedures and/or methods which can be incorporated into the methods of the invention: Stemmer (1999) "Molecular breeding of viruses for targeting and other clinical properties" Tumor Targeting 4:1-4; Ness (1999) Nature Biotechnology 17:893-896; Chang (1999) "Evolution of a cytokine using DNA family shuffling" Nature Biotechnology 17:793-797; Minshull (1999) "Protein evolution by molecular breeding" Current Opinion in Chemical Biology 3:284-290; Christians (1999) "Directed evolution of thymidine kinase for AZT phosphorylation using DNA family shuffling" Nature Biotechnology 17:259-264; Crameri (1998) "DNA shuffling of a family of genes from diverse species accelerates directed evolution" Nature 391:288-291; Crameri (1997) "Molecular evolution of an arsenate detoxification pathway by DNA shuffling," Nature Biotechnology 15:436-438; Zhang (1997) "Directed evolution of an effective fucosidase from a galactosidase by DNA shuffling and screening" Proc. Natl. Acad. Sci. USA 94:4504-4509; Patten et al. (1997) "Applications of DNA Shuffling to Pharmaceuticals and Vaccines" Current Opinion in Biotechnology 8:724-733; Crameri et al. (1996) "Construction and evolution of antibody-phage libraries by DNA shuffling" Nature Medicine 2:100-103; Gates et al. (1996) "Affinity selective isolation of ligands from peptide libraries through display on a lac repressor 'headpiece dimer'" Journal of Molecular Biology 255:373-386; Stemmer (1996) "Sexual PCR and Assembly PCR" In: The Encyclopedia of Molecular Biology. VCH Publishers, New York. pp. 447-457; Crameri and Stemmer (1995) "Combinatorial multiple cassette mutagenesis creates all the permutations of mutant and wildtype cassettes" BioTechniques 18:194-195; Stemmer et al. (1995) "Single-step assembly of a gene and entire plasmid form large numbers of oligodeoxyribonucleotides" Gene, 164:49-53; Stemmer (1995) "The Evolution of Molecular Computation" Science 270: 1510; Stemmer (1995) "Searching Sequence Space" Bio/Technology 13:549-553; Stemmer (1994) "Rapid evolution of a protein in vitro by DNA shuffling" Nature 370:389-391; and Stemmer (1994) "DNA shuffling by random fragmentation and reassembly: In vitro recombination for molecular evolution." Proc. Natl. Acad. Sci. USA 91:10747-10751.

Mutational methods of generating diversity include, for example, site-directed mutagenesis (Ling et al. (1997) "Approaches to DNA mutagenesis: an overview" Anal Biochem. 254(2): 157-178; Dale et al. (1996) "Oligonucleotide-directed random mutagenesis using the phosphorothioate method" Methods Mol. Biol. 57:369-374; Smith (1985) "In vitro mutagenesis" Ann. Rev. Genet. 19:423-462; Botstein & Shortle (1985) "Strategies and applications of in vitro mutagenesis" Science 229:1193-1201; Carter (1986) "Site-directed mutagenesis" Biochem. J. 237:1-7; and Kunkel (1987) "The efficiency of oligonucleotide directed mutagenesis" in Nucleic Acids & Molecular Biology (Eckstein, F. and Lilley, D. M. J. eds., Springer Verlag, Berlin)); mutagenesis using uracil containing templates (Kunkel (1985) "Rapid and efficient site-specific mutagenesis without phenotypic selection" Proc. Natl. Acad. Sci. USA 82:488-492; Kunkel et al. (1987) "Rapid and efficient site-specific mutagenesis without phenotypic selection" Methods in Enzymol. 154, 367-382; and Bass et al. (1988) "Mutant Trp repressors with new DNA-binding specificities" Science 242:240-245); oligonucleotide-directed mutagenesis (Methods in Enzymol. 100: 468-500 (1983); Methods in Enzymol. 154: 329-350 (1987); Zoller (1982) "Oligonucleotide-directed mutagenesis using M13-derived vectors: an efficient and general procedure for the production of point mutations in any DNA fragment" Nucleic Acids Res. 10:6487-6500; Zoller & Smith (1983) "Oligonucleotide-directed mutagenesis of DNA fragments cloned into M13 vectors" Methods in Enzymol. 100:468-500; and Zoller (1987) Oligonucleotide-directed mutagenesis: a simple method using two oligonucleotide primers and a single-stranded DNA template" Methods in Enzymol. 154: 329-350); phosphorothioate-modified DNA mutagenesis (Taylor (1985) "The use of phosphorothioate-modified DNA in restriction enzyme reactions to prepare nicked DNA" Nucl. Acids Res. 13: 8749-8764; Taylor (1985) "The rapid generation of oligonucleotide-directed mutations at high frequency using phosphorothioate-modified DNA" Nucl. Acids Res. 13: 8765-8787 (1985); Nakamaye (1986) "Inhibition of restriction endonuclease Nci I cleavage by phosphorothioate groups and its application to oligonucleotide-directed mutagenesis" Nucl. Acids Res. 14: 9679-9698; Sayers (1988) "Y-T Exonucleases in phosphorothioate-based oligonucleotide-directed mutagenesis" Nucl. Acids Res. 16:791-802; and Sayers et al. (1988) "Strand specific cleavage of phosphorothioate-containing DNA by reaction with restriction endonucleases in the presence of ethidium bromide" Nucl. Acids Res. 16: 803-814); mutagenesis using gapped duplex DNA (Kramer et al. (1984) "The gapped duplex DNA approach to oligonucleotide-directed mutation construction" Nucl. Acids Res. 12: 9441-9456; Kramer & Fritz (1987) Methods in Enzymol. "Oligonucleotide-directed construction of mutations via gapped duplex DNA" 154:350-367; Kramer (1988) "Improved enzymatic in vitro reactions in the gapped duplex DNA approach to oligonucleotide-directed construction of mutations" Nucl. Acids Res. 16: 7207; and Fritz (1988) "Oligonucleotide-directed construction of mutations: a gapped duplex DNA procedure without enzymatic reactions in vitro" Nucl. Acids Res. 16: 6987-6999).

Additional protocols that can be used to practice the invention include point mismatch repair (Kramer (1984) "Point Mismatch Repair" Cell 38:879-887), mutagenesis using repair-deficient host strains (Carter et al. (1985) "Improved oligonucleotide site-directed mutagenesis using M13 vectors" Nucl. Acids Res. 13: 4431-4443; and Carter (1987) "Improved oligonucleotide-directed mutagenesis using M13 vectors" Methods in Enzymol. 154: 382-403), deletion mutagenesis (Eghtedarzadeh (1986) "Use of oligonucleotides to generate large deletions" Nucl. Acids Res. 14: 5115), restriction-selection and restriction-selection and restriction-purification (Wells et al. (1986) "Importance of hydrogen-bond formation in stabilizing the transition state of subtilisin" Phil. Trans. R. Soc. Lond. A 317: 415-423), mutagenesis by total gene synthesis (Nambiar et al. (1984) "Total synthesis and cloning of a gene coding for the ribonuclease S protein" Science 223: 1299-1301; Sakamar and Khorana (1988) "Total synthesis and expression of a gene for the a-subunit of bovine rod outer segment guanine nucleotide-binding protein (transducin)" Nucl. Acids Res. 14: 6361-6372; Wells et al. (1985) "Cassette mutagenesis: an efficient method for generation of multiple mutations at defined sites" Gene 34:315-323; and Grundstrom et al. (1985) "Oligonucleotide-directed mutagenesis by microscale 'shotgun' gene synthesis" Nucl. Acids Res. 13: 3305-3316), double-strand break repair (Mandecki (1986); Arnold (1993) "Protein engineering for unusual environments" Current Opinion in Biotechnology 4:450-455. "Oligonucleotide-directed double-strand break repair in plasmids of *Escherichia coli*: a method for site-specific mutagenesis" Proc. Natl. Acad. Sci. USA, 83:7177-7181). Additional details on many of the above methods can be found in Methods in Enzymology Volume 154, which also describes useful controls for trouble-shooting problems with various mutagenesis methods.

Protocols that can be used to practice the invention are described, e.g., in U.S. Pat. No. 5,605,793 to Stemmer (Feb. 25, 1997), "Methods for In Vitro Recombination;" U.S. Pat. No. 5,811,238 to Stemmer et al. (Sep. 22, 1998) "Methods for Generating Polynucleotides having Desired Characteristics by Iterative Selection and Recombination;" U.S. Pat. No. 5,830,721 to Stemmer et al. (Nov. 3, 1998), "DNA Mutagenesis by Random Fragmentation and Reassembly;" U.S. Pat. No. 5,834,252 to Stemmer, et al. (Nov. 10, 1998) "End-Complementary Polymerase Reaction;" U.S. Pat. No. 5,837,458 to Minshull, et al. (Nov. 17, 1998), "Methods and Compositions for Cellular and Metabolic Engineering;" WO 95/22625, Stemmer and Crameri, "Mutagenesis by Random Fragmentation and Reassembly;" WO 96/33207 by Stemmer and Lipschutz "End Complementary Polymerase Chain Reaction;" WO 97/20078 by Stemmer and Crameri "Methods for Generating Polynucleotides having Desired Characteristics by Iterative Selection and Recombination;" WO 97/35966 by Minshull and Stemmer, "Methods and Compositions for Cellular and Metabolic Engineering;" WO 99/41402 by Punnonen et al. "Targeting of Genetic Vaccine Vectors;" WO 99/41383 by Punnonen et al. "Antigen Library Immunization;" WO 99/41369 by Punnonen et al. "Genetic Vaccine Vector Engineering;" WO 99/41368 by Punnonen et al. "Optimization of Immunomodulatory Properties of Genetic Vaccines;" EP 752008 by Stemmer and Crameri, "DNA Mutagenesis by Random Fragmentation and Reassembly;" EP 0932670 by Stemmer "Evolving Cellular DNA Uptake by Recursive Sequence Recombination;" WO 99/23107 by Stemmer et al., "Modification of Virus Tropism and Host Range by Viral Genome Shuffling;" WO 99/21979 by Apt et al., "Human Papillomavirus Vectors;" WO 98/31837 by del Cardayre et al. "Evolution of Whole Cells and Organisms by Recursive Sequence Recombination;" WO 98/27230 by Patten and Stemmer, "Methods and Compositions for Polypeptide Engineering;" WO 98/27230 by Stemmer et al., "Methods for Optimization of Gene Therapy by Recursive Sequence Shuffling and Selection," WO 00/00632, "Methods for Generating Highly Diverse Libraries," WO 00/09679, "Methods for Obtaining in Vitro Recombined Polynucleotide Sequence Banks and Resulting Sequences," WO 98/42832 by Arnold et al., "Recombination of Polynucleotide Sequences Using Random or Defined Primers," WO 99/29902 by Arnold et al., "Method for Creating Polynucleotide and Polypeptide Sequences," WO 98/41653 by Vind, "An in Vitro Method for Construction of a DNA Library," WO 98/41622 by Borchert et al., "Method for Constructing a Library Using DNA Shuffling," and WO 98/42727 by Pati and Zarling, "Sequence Alterations using Homologous Recombination."

Protocols that can be used to practice the invention (providing details regarding various diversity generating methods) are described, e.g., in U.S. patent application Ser. No. 09/407,800, "SHUFFLING OF CODON ALTERED GENES" by Patten et al. filed Sep. 28, 1999; "EVOLUTION OF WHOLE CELLS AND ORGANISMS BY RECURSIVE SEQUENCE RECOMBINATION" by del Cardayre et al., U.S. Pat. No. 6,379,964; "OLIGONUCLEOTIDE MEDIATED NUCLEIC ACID RECOMBINATION" by Crameri et al., U.S. Pat. Nos. 6,319,714; 6,368,861; 6,376,246; 6,423, 542; 6,426,224 and PCT/US00/01203; "USE OF CODON-VARIED OLIGONUCLEOTIDE SYNTHESIS FOR SYNTHETIC SHUFFLING" by Welch et al., U.S. Pat. No. 6,436, 675; "METHODS FOR MAKING CHARACTER STRINGS, POLYNUCLEOTIDES & POLYPEPTIDES HAVING DESIRED CHARACTERISTICS" by Selifonov et al., filed Jan. 18, 2000, (PCT/US00/01202) and, e.g. "METHODS FOR MAKING CHARACTER STRINGS, POLYNUCLEOTIDES & POLYPEPTIDES HAVING DESIRED CHARACTERISTICS" by Selifonov et al., filed Jul. 18, 2000 (U.S. Ser. No. 09/618,579); "METHODS OF POPULATING DATA STRUCTURES FOR USE IN EVOLUTIONARY SIMULATIONS" by Selifonov and Stemmer, filed Jan. 18, 2000 (PCT/US00/01138); and "SINGLE-STRANDED NUCLEIC ACID TEMPLATE-MEDIATED RECOMBINATION AND NUCLEIC ACID FRAGMENT ISOLATION" by Affholter, filed Sep. 6, 2000 (U.S. Ser. No. 09/656,549); and U.S. Pat. Nos. 6,177,263; 6,153,410.

Non-stochastic, or "directed evolution," methods include, e.g., saturation mutagenesis (GSSM™), synthetic ligation reassembly (SLR), or a combination thereof are used to modify the nucleic acids of the invention to generate xylanases with new or altered properties (e.g., activity under highly acidic or alkaline conditions, high or low temperatures, and the like). Polypeptides encoded by the modified nucleic acids can be screened for an activity before testing for xylan hydrolysis or other activity. Any testing modality or protocol can be used, e.g., using a capillary array platform. See, e.g., U.S. Pat. Nos. 6,361,974; 6,280,926; 5,939,250.

Saturation Mutagenesis, or, GSSM™

In one aspect, codon primers containing a degenerate N,N,G/T sequence are used to introduce point mutations into a polynucleotide, e.g., a xylanase or an antibody of the invention, so as to generate a set of progeny polypeptides in which a full range of single amino acid substitutions is represented at each amino acid position, e.g., an amino acid residue in an enzyme active site or ligand binding site targeted to be modified. These oligonucleotides can comprise a contiguous first homologous sequence, a degenerate N,N,G/T sequence, and, optionally, a second homologous sequence. The downstream progeny translational products from the use of such oligonucleotides include all possible amino acid changes at each amino acid site along the polypeptide, because the degeneracy of the N,N,G/T sequence includes codons for all 20 amino acids. In one aspect, one such degenerate oligonucleotide (comprised of, e.g., one degenerate N,N,G/T cassette) is used for subjecting each original codon in a parental polynucleotide template to a full range of codon substitutions. In another aspect, at least two degenerate cassettes are used—either in the same oligonucleotide or not, for subjecting at least two original codons in a parental polynucleotide template to a full range of codon substitutions. For example, more than one N,N,G/T sequence can be contained in one oligonucleotide to introduce amino acid mutations at more than one site. This plurality of N,N,G/T sequences can be directly contiguous, or separated by one or more additional nucleotide sequence(s). In another aspect, oligonucleotides serviceable for introducing additions and deletions can be used either alone or in combination with the codons containing an N,N, G/T sequence, to introduce any combination or permutation of amino acid additions, deletions, and/or substitutions.

In one aspect, simultaneous mutagenesis of two or more contiguous amino acid positions is done using an oligonucleotide that contains contiguous N,N,G/T triplets, i.e. a degenerate $(N,N,G/T)_n$ sequence. In another aspect, degenerate cassettes having less degeneracy than the N,N,G/T sequence are used. For example, it may be desirable in some instances to use (e.g. in an oligonucleotide) a degenerate triplet sequence comprised of only one N, where said N can be in the first second or third position of the triplet. Any other bases including any combinations and permutations thereof can be used in the remaining two positions of the triplet. Alternatively, it may be desirable in some instances to use (e.g. in an oligo) a degenerate N,N,N triplet sequence.

In one aspect, use of degenerate triplets (e.g., N,N,G/T triplets) allows for systematic and easy generation of a full range of possible natural amino acids (for a total of 20 amino acids) into each and every amino acid position in a polypeptide (in alternative aspects, the methods also include generation of less than all possible substitutions per amino acid residue, or codon, position). For example, for a 100 amino acid polypeptide, 2000 distinct species (i.e. 20 possible amino acids per position X 100 amino acid positions) can be generated. Through the use of an oligonucleotide or set of oligonucleotides containing a degenerate N,N,G/T triplet, 32 individual sequences can code for all 20 possible natural amino acids. Thus, in a reaction vessel in which a parental polynucleotide sequence is subjected to saturation mutagenesis using at least one such oligonucleotide, there are generated 32 distinct progeny polynucleotides encoding 20 distinct polypeptides. In contrast, the use of a non-degenerate oligonucleotide in site-directed mutagenesis leads to only one progeny polypeptide product per reaction vessel. Nondegenerate oligonucleotides can optionally be used in combination with degenerate primers disclosed; for example, nondegenerate oligonucleotides can be used to generate specific point mutations in a working polynucleotide. This provides one means to generate specific silent point mutations, point mutations leading to corresponding amino acid changes, and point mutations that cause the generation of stop codons and the corresponding expression of polypeptide fragments.

In one aspect, each saturation mutagenesis reaction vessel contains polynucleotides encoding at least 20 progeny polypeptide (e.g., xylanases) molecules such that all 20 natural amino acids are represented at the one specific amino acid position corresponding to the codon position mutagenized in the parental polynucleotide (other aspects use less than all 20 natural combinations). The 32-fold degenerate progeny polypeptides generated from each saturation mutagenesis reaction vessel can be subjected to clonal amplification (e.g. cloned into a suitable host, e.g., E. coli host, using, e.g., an expression vector) and subjected to expression screening. When an individual progeny polypeptide is identified by screening to display a favorable change in property (when compared to the parental polypeptide, such as increased xylan hydrolysis activity under alkaline or acidic conditions), it can be sequenced to identify the correspondingly favorable amino acid substitution contained therein.

In one aspect, upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid, and each of two favorable changes) and 3 positions. Thus, there are 3×3×3 or 27 total possibilities, including 7 that were previously examined —6 single point mutations (i.e. 2 at each of three positions) and no change at any position.

In yet another aspect, site-saturation mutagenesis can be used together with shuffling, chimerization, recombination and other mutagenizing processes, along with screening. This invention provides for the use of any mutagenizing process (es), including saturation mutagenesis, in an iterative manner. In one exemplification, the iterative use of any mutagenizing process(es) is used in combination with screening.

The invention also provides for the use of proprietary codon primers (containing a degenerate N,N,N sequence) to introduce point mutations into a polynucleotide, so as to generate a set of progeny polypeptides in which a full range of single amino acid substitutions is represented at each amino acid position (gene site saturated mutagenesis (GSSM™)). The oligos used are comprised contiguously of a first homologous sequence, a degenerate N,N,N sequence and preferably but not necessarily a second homologous sequence. The downstream progeny translational products from the use of such oligos include all possible amino acid changes at each amino acid site along the polypeptide, because the degeneracy of the N,N,N sequence includes codons for all 20 amino acids.

In one aspect, one such degenerate oligo (comprised of one degenerate N,N,N cassette) is used for subjecting each original codon in a parental polynucleotide template to a full range of codon substitutions. In another aspect, at least two degenerate N,N,N cassettes are used—either in the same oligo or not, for subjecting at least two original codons in a parental polynucleotide template to a full range of codon substitutions. Thus, more than one N,N,N sequence can be contained in one oligo to introduce amino acid mutations at more than one site. This plurality of N,N,N sequences can be directly contiguous, or separated by one or more additional nucleotide sequence(s). In another aspect, oligos serviceable for introducing additions and deletions can be used either alone or in combination with the codons containing an N,N,N sequence, to introduce any combination or permutation of amino acid additions, deletions and/or substitutions.

In a particular exemplification, it is possible to simultaneously mutagenize two or more contiguous amino acid positions using an oligo that contains contiguous N,N,N triplets, i.e. a degenerate $(N,N,N)_n$ sequence.

In another aspect, the present invention provides for the use of degenerate cassettes having less degeneracy than the N,N,N sequence. For example, it may be desirable in some instances to use (e.g. in an oligo) a degenerate triplet sequence comprised of only one N, where the N can be in the first second or third position of the triplet. Any other bases including any combinations and permutations thereof can be used in the remaining two positions of the triplet. Alternatively, it may be desirable in some instances to use (e.g., in an oligo) a degenerate N,N,N triplet sequence, N,N,G/T, or an N,N, GIC triplet sequence.

It is appreciated, however, that the use of a degenerate triplet (such as N,N,G/T or an N,N, G/C triplet sequence) as disclosed in the instant invention is advantageous for several reasons. In one aspect, this invention provides a means to systematically and fairly easily generate the substitution of the full range of possible amino acids (for a total of 20 amino acids) into each and every amino acid position in a polypeptide. Thus, for a 100 amino acid polypeptide, the invention provides a way to systematically and fairly easily generate 2000 distinct species (i.e., 20 possible amino acids per position times 100 amino acid positions). It is appreciated that there is provided, through the use of an oligo containing a degenerate N,N,G/T or an N,N, G/C triplet sequence, 32 individual sequences that code for 20 possible amino acids. Thus, in a reaction vessel in which a parental polynucleotide sequence is subjected to saturation mutagenesis using one such oligo, there are generated 32 distinct progeny polynucleotides encoding 20 distinct polypeptides. In contrast, the use of a non-degenerate oligo in site-directed mutagenesis leads to only one progeny polypeptide product per reaction vessel.

This invention also provides for the use of nondegenerate oligos, which can optionally be used in combination with degenerate primers disclosed. It is appreciated that in some situations, it is advantageous to use nondegenerate oligos to generate specific point mutations in a working polynucleotide. This provides a means to generate specific silent point mutations, point mutations leading to corresponding amino acid changes and point mutations that cause the generation of stop codons and the corresponding expression of polypeptide fragments.

Thus, in one aspect of this invention, each saturation mutagenesis reaction vessel contains polynucleotides encoding at least 20 progeny polypeptide molecules such that all 20 amino acids are represented at the one specific amino acid position corresponding to the codon position mutagenized in the parental polynucleotide. The 32-fold degenerate progeny polypeptides generated from each saturation mutagenesis reaction vessel can be subjected to clonal amplification (e.g., cloned into a suitable *E. coli* host using an expression vector) and subjected to expression screening. When an individual progeny polypeptide is identified by screening to display a favorable change in property (when compared to the parental polypeptide), it can be sequenced to identify the correspondingly favorable amino acid substitution contained therein.

It is appreciated that upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid and each of two favorable changes) and 3 positions. Thus, there are 3×3×3 or 27 total possibilities, including 7 that were previously examined—6 single point mutations (i.e., 2 at each of three positions) and no change at any position.

Thus, in a non-limiting exemplification, this invention provides for the use of saturation mutagenesis in combination with additional mutagenization processes, such as process where two or more related polynucleotides are introduced into a suitable host cell such that a hybrid polynucleotide is generated by recombination and reductive reassortment.

In addition to performing mutagenesis along the entire sequence of a gene, the instant invention provides that mutagenesis can be use to replace each of any number of bases in a polynucleotide sequence, wherein the number of bases to be mutagenized is preferably every integer from 15 to 100,000. Thus, instead of mutagenizing every position along a molecule, one can subject every or a discrete number of bases (preferably a subset totaling from 15 to 100,000) to mutagenesis. Preferably, a separate nucleotide is used for mutagenizing each position or group of positions along a polynucleotide sequence. A group of 3 positions to be mutagenized may be a codon. The mutations are preferably introduced using a mutagenic primer, containing a heterologous cassette, also referred to as a mutagenic cassette. Exemplary cassettes can have from 1 to 500 bases. Each nucleotide position in such heterologous cassettes be N, A, C, G, T, A/C, A/G, A/T, C/G, C/T, G/T, C/G/T, A/G/T, A/C/T, A/C/G, or E, where E is any base that is not A, C, G, or T (E can be referred to as a designer oligo).

In a general sense, saturation mutagenesis is comprised of mutagenizing a complete set of mutagenic cassettes (wherein each cassette is preferably about 1-500 bases in length) in defined polynucleotide sequence to be mutagenized (wherein the sequence to be mutagenized is preferably from about 15 to 100,000 bases in length). Thus, a group of mutations (ranging from 1 to 100 mutations) is introduced into each cassette to be mutagenized. A grouping of mutations to be introduced into one cassette can be different or the same from a second grouping of mutations to be introduced into a second cassette during the application of one round of saturation mutagenesis. Such groupings are exemplified by deletions, additions, groupings of particular codons and groupings of particular nucleotide cassettes.

Defined sequences to be mutagenized include a whole gene, pathway, cDNA, an entire open reading frame (ORF) and entire promoter, enhancer, repressor/transactivator, origin of replication, intron, operator, or any polynucleotide functional group. Generally, a "defined sequences" for this purpose may be any polynucleotide that a 15 base-polynucleotide sequence and polynucleotide sequences of lengths between 15 bases and 15,000 bases (this invention specifically names every integer in between). Considerations in choosing groupings of codons include types of amino acids encoded by a degenerate mutagenic cassette.

In one exemplification a grouping of mutations that can be introduced into a mutagenic cassette, this invention specifically provides for degenerate codon substitutions (using degenerate oligos) that code for 2, 3, 4, 5, 6, 7, 8, 9, 10, 11, 12, 13, 14, 15, 16, 17, 18, 19 and 20 amino acids at each position and a library of polypeptides encoded thereby.

Synthetic Ligatioin Reassembly (SLR)

The invention provides a non-stochastic gene modification system termed "synthetic ligation reassembly," or simply "SLR," a "directed evolution process," to generate polypeptides, e.g., xylanases or antibodies of the invention, with new or altered properties.

SLR is a method of ligating oligonucleotide fragments together non-stochastically. This method differs from stochastic oligonucleotide shuffling in that the nucleic acid building blocks are not shuffled, concatenated or chimerized randomly, but rather are assembled non-stochastically. See, e.g., U.S. patent application Ser. No. 09/332,835 entitled "Synthetic Ligation Reassembly in Directed Evolution" and filed on Jun. 14, 1999 ("U.S. Ser. No. 09/332,835"). In one aspect, SLR comprises the following steps: (a) providing a template polynucleotide, wherein the template polynucleotide comprises sequence encoding a homologous gene; (b) providing a plurality of building block polynucleotides, wherein the building block polynucleotides are designed to cross-over reassemble with the template polynucleotide at a predetermined sequence, and a building block polynucleotide comprises a sequence that is a variant of the homologous gene and a sequence homologous to the template polynucleotide flanking the variant sequence; (c) combining a building block polynucleotide with a template polynucleotide such that the building block polynucleotide cross-over reassembles with the template polynucleotide to generate polynucleotides comprising homologous gene sequence variations.

SLR does not depend on the presence of high levels of homology between polynucleotides to be rearranged. Thus, this method can be used to non-stochastically generate libraries (or sets) of progeny molecules comprised of over $10^{100}$ different chimeras. SLR can be used to generate libraries comprised of over $10^{1000}$ different progeny chimeras. Thus, aspects of the present invention include non-stochastic methods of producing a set of finalized chimeric nucleic acid molecule shaving an overall assembly order that is chosen by design. This method includes the steps of generating by design a plurality of specific nucleic acid building blocks having serviceable mutually compatible ligatable ends, and assembling these nucleic acid building blocks, such that a designed overall assembly order is achieved.

The mutually compatible ligatable ends of the nucleic acid building blocks to be assembled are considered to be "serviceable" for this type of ordered assembly if they enable the building blocks to be coupled in predetermined orders. Thus, the overall assembly order in which the nucleic acid building blocks can be coupled is specified by the design of the ligatable ends. If more than one assembly step is to be used, then the overall assembly order in which the nucleic acid building blocks can be coupled is also specified by the sequential order of the assembly step(s). In one aspect, the annealed building pieces are treated with an enzyme, such as a ligase (e.g. T4 DNA ligase), to achieve covalent bonding of the building pieces.

In one aspect, the design of the oligonucleotide building blocks is obtained by analyzing a set of progenitor nucleic acid sequence templates that serve as a basis for producing a progeny set of finalized chimeric polynucleotides. These parental oligonucleotide templates thus serve as a source of sequence information that aids in the design of the nucleic acid building blocks that are to be mutagenized, e.g., chimerized or shuffled. In one aspect of this method, the sequences of a plurality of parental nucleic acid templates are aligned in order to select one or more demarcation points. The demarcation points can be located at an area of homology, and are comprised of one or more nucleotides. These demarcation points are preferably shared by at least two of the progenitor templates. The demarcation points can thereby be used to delineate the boundaries of oligonucleotide building blocks to be generated in order to rearrange the parental polynucleotides. The demarcation points identified and selected in the progenitor molecules serve as potential chimerization points in the assembly of the final chimeric progeny molecules. A demarcation point can be an area of homology (comprised of at least one homologous nucleotide base) shared by at least two parental polynucleotide sequences. Alternatively, a demarcation point can be an area of homology that is shared by at least half of the parental polynucleotide sequences, or, it can be an area of homology that is shared by at least two thirds of the parental polynucleotide sequences. Even more preferably a serviceable demarcation points is an area of homology that is shared by at least three fourths of the parental polynucleotide sequences, or, it can be shared by at almost all of the parental polynucleotide sequences. In one aspect, a demarcation point is an area of homology that is shared by all of the parental polynucleotide sequences.

In one aspect, a ligation reassembly process is performed exhaustively in order to generate an exhaustive library of progeny chimeric polynucleotides. In other words, all possible ordered combinations of the nucleic acid building blocks are represented in the set of finalized chimeric nucleic acid molecules. At the same time, in another aspect, the assembly order (i.e. the order of assembly of each building block in the 5' to 3 sequence of each finalized chimeric nucleic acid) in each combination is by design (or non-stochastic) as described above. Because of the non-stochastic nature of this invention, the possibility of unwanted side products is greatly reduced.

In another aspect, the ligation reassembly method is performed systematically. For example, the method is performed in order to generate a systematically compartmentalized library of progeny molecules, with compartments that can be screened systematically, e.g. one by one. In other words this invention provides that, through the selective and judicious use of specific nucleic acid building blocks, coupled with the selective and judicious use of sequentially stepped assembly reactions, a design can be achieved where specific sets of progeny products are made in each of several reaction vessels. This allows a systematic examination and screening procedure to be performed. Thus, these methods allow a potentially very large number of progeny molecules to be examined systematically in smaller groups. Because of its ability to perform chimerizations in a manner that is highly flexible yet exhaustive and systematic as well, particularly when there is a low level of homology among the progenitor molecules, these methods provide for the generation of a library (or set) comprised of a large number of progeny molecules. Because of the non-stochastic nature of the instant ligation reassembly invention, the progeny molecules generated preferably comprise a library of finalized chimeric nucleic acid molecules having an overall assembly order that is chosen by design. The saturation mutagenesis and optimized directed evolution methods also can be used to generate different progeny molecular species. It is appreciated that the invention provides freedom of choice and control regarding the selection of demarcation points, the size and number of the nucleic acid building blocks, and the size and design of the couplings. It is appreciated, furthermore, that the requirement for intermolecular homology is highly relaxed for the operability of this invention. In fact, demarcation points can even be chosen in areas of little or no intermolecular homology. For example, because of codon wobble, i.e. the degeneracy of codons, nucleotide substitutions can be introduced into nucleic acid building blocks without altering the amino acid originally encoded in the corresponding progenitor template. Alternatively, a codon can be altered such that the coding for an originally amino acid is altered. This invention provides that such substitutions can be introduced into the nucleic acid building block in order to increase the incidence of intermolecular homologous demarcation points and thus to allow an increased number of couplings to be achieved among the building blocks, which in turn allows a greater number of progeny chimeric molecules to be generated.

Synthetic Gene Reassembly

In one aspect, the present invention provides a non-stochastic method termed synthetic gene reassembly (e.g., GeneReassembly™, see, e.g., U.S. Pat. No. 6,537,776), which differs from stochastic shuffling in that the nucleic acid building blocks are not shuffled or concatenated or chimerized randomly, but rather are assembled non-stochastically.

The synthetic gene reassembly method does not depend on the presence of a high level of homology between polynucleotides to be shuffled. The invention can be used to non-stochastically generate libraries (or sets) of progeny molecules comprised of over $10^{100}$ different chimeras. Conceivably, synthetic gene reassembly can even be used to generate libraries comprised of over $10^{1000}$ different progeny chimeras.

Thus, in one aspect, the invention provides a non-stochastic method of producing a set of finalized chimeric nucleic acid molecules having an overall assembly order that is chosen by design, which method is comprised of the steps of generating by design a plurality of specific nucleic acid building blocks having serviceable mutually compatible ligatable ends and assembling these nucleic acid building blocks, such that a designed overall assembly order is achieved.

In one aspect, synthetic gene reassembly comprises a method of: 1) preparing a progeny generation of molecule(s) (including a molecule comprising a polynucleotide sequence, e.g., a molecule comprising a polypeptide coding sequence), that is mutagenized to achieve at least one point mutation, addition, deletion, &/or chimerization, from one or more ancestral or parental generation template(s); 2) screening the progeny generation molecule(s), e.g., using a high throughput method, for at least one property of interest (such as an improvement in an enzyme activity); 3) optionally obtaining &/or cataloguing structural &/or and functional information regarding the parental &/or progeny generation molecules; and 4) optionally repeating any of steps 1) to 3). In one aspect, there is generated (e.g., from a parent polynucleotide template), in what is termed "codon site-saturation mutagenesis," a progeny generation of polynucleotides, each having at least one set of up to three contiguous point mutations (i.e. different bases comprising a new codon), such that every codon (or every family of degenerate codons encoding the same amino acid) is represented at each codon position. Corresponding to, and encoded by, this progeny generation of polynucleotides, there is also generated a set of progeny polypeptides, each having at least one single amino acid point mutation. In a one aspect, there is generated, in what is termed "amino acid site-saturation mutagenesis", one such mutant polypeptide for each of the 19 naturally encoded polypeptide-forming alpha-amino acid substitutions at each and every amino acid position along the polypeptide. This yields, for each and every amino acid position along the parental polypeptide, a total of 20 distinct progeny polypeptides including the original amino acid, or potentially more than 21 distinct progeny polypeptides if additional amino acids are used either instead of or in addition to the 20 naturally encoded amino acids Thus, in another aspect, this approach is also serviceable for generating mutants containing, in addition to &/or in combination with the 20 naturally encoded polypeptide-forming alpha-amino acids, other rare &/or not naturally-encoded amino acids and amino acid derivatives. In yet another aspect, this approach is also serviceable for generating mutants by the use of, in addition to &/or in combination with natural or unaltered codon recognition systems of suitable hosts, altered, mutagenized, &/or designer codon recognition systems (such as in a host cell with one or more altered tRNA molecules.

In yet another aspect, this invention relates to recombination and more specifically to a method for preparing polynucleotides encoding a polypeptide by a method of in vivo re-assortment of polynucleotide sequences containing regions of partial homology, assembling the polynucleotides to form at least one polynucleotide and screening the polynucleotides for the production of polypeptide(s) having a useful property.

In yet another aspect, this invention is serviceable for analyzing and cataloguing, with respect to any molecular property (e.g. an enzymatic activity) or combination of properties allowed by current technology, the effects of any mutational change achieved (including particularly saturation mutagenesis). Thus, a comprehensive method is provided for determining the effect of changing each amino acid in a parental polypeptide into each of at least 19 possible substitutions. This allows each amino acid in a parental polypeptide to be characterized and catalogued according to its spectrum of potential effects on a measurable property of the polypeptide.

In one aspect, an intron may be introduced into a chimeric progeny molecule by way of a nucleic acid building block. Introns often have consensus sequences at both termini in order to render them operational. In addition to enabling gene splicing, introns may serve an additional purpose by providing sites of homology to other nucleic acids to enable homologous recombination. For this purpose, and potentially others, it may be sometimes desirable to generate a large nucleic acid building block for introducing an intron. If the size is overly large easily generating by direct chemical synthesis of two single stranded oligos, such a specialized nucleic acid building block may also be generated by direct chemical synthesis of more than two single stranded oligos or by using a polymerase-based amplification reaction The mutually compatible ligatable ends of the nucleic acid building blocks to be assembled are considered to be "serviceable" for this type of ordered assembly if they enable the building blocks to be coupled in predetermined orders. Thus, in one aspect, the overall assembly order in which the nucleic acid building blocks can be coupled is specified by the design of the ligatable ends and, if more than one assembly step is to be used, then the overall assembly order in which the nucleic acid building blocks can be coupled is also specified by the sequential order of the assembly step(s). In a one aspect of the invention, the annealed building pieces are treated with an enzyme, such as a ligase (e.g., T4 DNA ligase) to achieve covalent bonding of the building pieces.

Coupling can occur in a manner that does not make use of every nucleotide in a participating overhang. The coupling is particularly lively to survive (e.g. in a transformed host) if the coupling reinforced by treatment with a ligase enzyme to form what may be referred to as a "gap ligation" or a "gapped ligation". This type of coupling can contribute to generation of unwanted background product(s), but it can also be used advantageously increase the diversity of the progeny library generated by the designed ligation reassembly. Certain overhangs are able to undergo self-coupling to form a palindromic coupling. A coupling is strengthened substantially if it is reinforced by treatment with a ligase enzyme. Lack of 5' phosphates on these overhangs can be used advantageously to prevent this type of palindromic self-ligation. Accordingly, this invention provides that nucleic acid building blocks can be chemically made (or ordered) that lack a 5' phosphate group. Alternatively, they can be removed, e.g. by treatment with a phosphatase enzyme, such as a calf intestinal alkaline phosphatase (CIAP), in order to prevent palindromic self-ligations in ligation reassembly processes.

In a another aspect, the design of nucleic acid building blocks is obtained upon analysis of the sequences of a set of progenitor nucleic acid templates that serve as a basis for producing a progeny set of finalized chimeric nucleic acid molecules. These progenitor nucleic acid templates thus serve as a source of sequence information that aids in the design of the nucleic acid building blocks that are to be mutagenized, i.e. chimerized or shuffled.

In one exemplification, the invention provides for the chimerization of a family of related genes and their encoded family of related products. In a particular exemplification, the encoded products are enzymes. The xylanases of the present invention can be mutagenized in accordance with the methods described herein.

Thus according to one aspect of the invention, the sequences of a plurality of progenitor nucleic acid templates (e.g., polynucleotides of Group A nucleic acid sequences) are aligned in order to select one or more demarcation points, which demarcation points can be located at an area of homology. The demarcation points can be used to delineate the boundaries of nucleic acid building blocks to be generated. Thus, the demarcation points identified and selected in the progenitor molecules serve as potential chimerization points in the assembly of the progeny molecules.

Typically a serviceable demarcation point is an area of homology (comprised of at least one homologous nucleotide base) shared by at least two progenitor templates, but the demarcation point can be an area of homology that is shared by at least half of the progenitor templates, at least two thirds of the progenitor templates, at least three fourths of the progenitor templates and preferably at almost all of the progenitor templates. Even more preferably still a serviceable demarcation point is an area of homology that is shared by all of the progenitor templates.

In a one aspect, the gene reassembly process is performed exhaustively in order to generate an exhaustive library. In other words, all possible ordered combinations of the nucleic acid building blocks are represented in the set of finalized chimeric nucleic acid molecules. At the same time, the assembly order (i.e. the order of assembly of each building block in the 5' to 3 sequence of each finalized chimeric nucleic acid) in each combination is by design (or non-stochastic). Because of the non-stochastic nature of the method, the possibility of unwanted side products is greatly reduced.

In another aspect, the method provides that the gene reassembly process is performed systematically, for example to generate a systematically compartmentalized library, with compartments that can be screened systematically, e.g., one by one. In other words the invention provides that, through the selective and judicious use of specific nucleic acid building blocks, coupled with the selective and judicious use of sequentially stepped assembly reactions, an experimental design can be achieved where specific sets of progeny products are made in each of several reaction vessels. This allows a systematic examination and screening procedure to be performed. Thus, it allows a potentially very large number of progeny molecules to be examined systematically in smaller groups.

Because of its ability to perform chimerizations in a manner that is highly flexible yet exhaustive and systematic as well, particularly when there is a low level of homology among the progenitor molecules, the instant invention provides for the generation of a library (or set) comprised of a large number of progeny molecules. Because of the non-stochastic nature of the instant gene reassembly invention, the progeny molecules generated preferably comprise a library of finalized chimeric nucleic acid molecules having an overall assembly order that is chosen by design. In a particularly aspect, such a generated library is comprised of greater than $10^3$ to greater than $10^{1000}$ different progeny molecular species.

In one aspect, a set of finalized chimeric nucleic acid molecules, produced as described is comprised of a polynucleotide encoding a polypeptide. According to one aspect, this polynucleotide is a gene, which may be a man-made gene. According to another aspect, this polynucleotide is a gene pathway, which may be a man-made gene pathway. The invention provides that one or more man-made genes generated by the invention may be incorporated into a man-made gene pathway, such as pathway operable in a eukaryotic organism (including a plant).

In another exemplification, the synthetic nature of the step in which the building blocks are generated allows the design and introduction of nucleotides (e.g. one or more nucleotides, which may be, for example, codons or introns or regulatory sequences) that can later be optionally removed in an in vitro process (e.g., by mutagenesis) or in an in vivo process (e.g., by utilizing the gene splicing ability of a host organism). It is appreciated that in many instances the introduction of these nucleotides may also be desirable for many other reasons in addition to the potential benefit of creating a serviceable demarcation point.

Thus, according to another aspect, the invention provides that a nucleic acid building block can be used to introduce an intron. Thus, the invention provides that functional introns may be introduced into a man-made gene of the invention. The invention also provides that functional introns may be introduced into a man-made gene pathway of the invention. Accordingly, the invention provides for the generation of a chimeric polynucleotide that is a man-made gene containing one (or more) artificially introduced intron(s).

Accordingly, the invention also provides for the generation of a chimeric polynucleotide that is a man-made gene pathway containing one (or more) artificially introduced intron(s). Preferably, the artificially introduced intron(s) are functional in one or more host cells for gene splicing much in the way that naturally-occurring introns serve functionally in gene splicing. The invention provides a process of producing man-made intron-containing polynucleotides to be introduced into host organisms for recombination and/or splicing.

A man-made gene produced using the invention can also serve as a substrate for recombination with another nucleic acid. Likewise, a man-made gene pathway produced using the invention can also serve as a substrate for recombination with another nucleic acid. In a one aspect, the recombination is facilitated by, or occurs at, areas of homology between the man-made, intron-containing gene and a nucleic acid, which serves as a recombination partner. In one aspect, the recombination partner may also be a nucleic acid generated by the invention, including a man-made gene or a man-made gene pathway. Recombination may be facilitated by or may occur at areas of homology that exist at the one (or more) artificially introduced intron(s) in the man-made gene.

The synthetic gene reassembly method of the invention utilizes a plurality of nucleic acid building blocks, each of which preferably has two ligatable ends. The two ligatable ends on each nucleic acid building block may be two blunt ends (i.e. each having an overhang of zero nucleotides), or preferably one blunt end and one overhang, or more preferably still two overhangs.

A useful overhang for this purpose may be a 3' overhang or a 5' overhang. Thus, a nucleic acid building block may have a 3' overhang or alternatively a 5' overhang or alternatively two 3' overhangs or alternatively two 5' overhangs. The overall order in which the nucleic acid building blocks are assembled to form a finalized chimeric nucleic acid molecule is determined by purposeful experimental design and is not random.

In one aspect, a nucleic acid building block is generated by chemical synthesis of two single-stranded nucleic acids (also referred to as single-stranded oligos) and contacting them so as to allow them to anneal to form a double-stranded nucleic acid building block.

A double-stranded nucleic acid building block can be of variable size. The sizes of these building blocks can be small or large. Exemplary sizes for building block range from 1 base pair (not including any overhangs) to 100,000 base pairs (not including any overhangs). Other exemplary size ranges are also provided, which have lower limits of from 1 bp to 10,000 bp (including every integer value in between) and upper limits of from 2 bp to 100,000 bp (including every integer value in between).

Many methods exist by which a double-stranded nucleic acid building block can be generated that is serviceable for the invention; and these are known in the art and can be readily performed by the skilled artisan.

According to one aspect, a double-stranded nucleic acid building block is generated by first generating two single stranded nucleic acids and allowing them to anneal to form a double-stranded nucleic acid building block. The two strands of a double-stranded nucleic acid building block may be complementary at every nucleotide apart from any that form an overhang; thus containing no mismatches, apart from any overhang(s). According to another aspect, the two strands of a double-stranded nucleic acid building block are complementary at fewer than every nucleotide apart from any that form an overhang. Thus, according to this aspect, a double-stranded nucleic acid building block can be used to introduce codon degeneracy. Preferably the codon degeneracy is introduced using the site-saturation mutagenesis described herein, using one or more N,N,G/T cassettes or alternatively using one or more N,N,N cassettes.

The in vivo recombination method of the invention can be performed blindly on a pool of unknown hybrids or alleles of a specific polynucleotide or sequence. However, it is not necessary to know the actual DNA or RNA sequence of the specific polynucleotide.

The approach of using recombination within a mixed population of genes can be useful for the generation of any useful proteins, for example, interleukin I, antibodies, tPA and growth hormone. This approach may be used to generate proteins having altered specificity or activity. The approach may also be useful for the generation of hybrid nucleic acid sequences, for example, promoter regions, introns, exons, enhancer sequences, 31 untranslated regions or 51 untranslated regions of genes. Thus this approach may be used to generate genes having increased rates of expression. This approach may also be useful in the study of repetitive DNA sequences. Finally, this approach may be useful to mutate ribozymes or aptamers.

In one aspect the invention described herein is directed to the use of repeated cycles of reductive reassortment, recombination and selection which allow for the directed molecular evolution of highly complex linear sequences, such as DNA, RNA or proteins thorough recombination.

Optimized Directed Evolution System

The invention provides a non-stochastic gene modification system termed "optimized directed evolution system" to generate polypeptides, e.g., xylanases or antibodies of the invention, with new or altered properties. Optimized directed evolution is directed to the use of repeated cycles of reductive reassortment, recombination and selection that allow for the directed molecular evolution of nucleic acids through recombination. Optimized directed evolution allows generation of a large population of evolved chimeric sequences, wherein the generated population is significantly enriched for sequences that have a predetermined number of crossover events.

A crossover event is a point in a chimeric sequence where a shift in sequence occurs from one parental variant to another parental variant. Such a point is normally at the juncture of where oligonucleotides from two parents are ligated together to form a single sequence. This method allows calculation of the correct concentrations of oligonucleotide sequences so that the final chimeric population of sequences is enriched for the chosen number of crossover events. This provides more control over choosing chimeric variants having a predetermined number of crossover events.

In addition, this method provides a convenient means for exploring a tremendous amount of the possible protein variant space in comparison to other systems. Previously, if one generated, for example, $10^{13}$ chimeric molecules during a reaction, it would be extremely difficult to test such a high number of chimeric variants for a particular activity. Moreover, a significant portion of the progeny population would have a very high number of crossover events which resulted in proteins that were less likely to have increased levels of a particular activity. By using these methods, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

One method for creating a chimeric progeny polynucleotide sequence is to create oligonucleotides corresponding to fragments or portions of each parental sequence. Each oligonucleotide preferably includes a unique region of overlap so that mixing the oligonucleotides together results in a new variant that has each oligonucleotide fragment assembled in the correct order. Additional information can also be found, e.g., in U.S. Ser. No. 09/332,835; U.S. Pat. No. 6,361,974.

The number of oligonucleotides generated for each parental variant bears a relationship to the total number of resulting crossovers in the chimeric molecule that is ultimately created. For example, three parental nucleotide sequence variants might be provided to undergo a ligation reaction in order to find a chimeric variant having, for example, greater activity at high temperature. As one example, a set of 50 oligonucleotide sequences can be generated corresponding to each portions of each parental variant. Accordingly, during the ligation reassembly process there could be up to 50 crossover events within each of the chimeric sequences. The probability that each of the generated chimeric polynucleotides will contain oligonucleotides from each parental variant in alternating order is very low. If each oligonucleotide fragment is present in the ligation reaction in the same molar quantity it is likely that in some positions oligonucleotides from the same parental polynucleotide will ligate next to one another and thus not result in a crossover event. If the concentration of each oligonucleotide from each parent is kept constant during any ligation step in this example, there is a ⅓ chance (assuming 3 parents) that an oligonucleotide from the same parental variant will ligate within the chimeric sequence and produce no crossover.

Accordingly, a probability density function (PDF) can be determined to predict the population of crossover events that are likely to occur during each step in a ligation reaction given a set number of parental variants, a number of oligonucleotides corresponding to each variant, and the concentrations of each variant during each step in the ligation reaction. The statistics and mathematics behind determining the PDF is described below. By utilizing these methods, one can calculate such a probability density function, and thus enrich the chimeric progeny population for a predetermined number of crossover events resulting from a particular ligation reaction. Moreover, a target number of crossover events can be predetermined, and the system then programmed to calculate the starting quantities of each parental oligonucleotide during each step in the ligation reaction to result in a probability density function that centers on the predetermined number of crossover events. These methods are directed to the use of repeated cycles of reductive reassortment, recombination and selection that allow for the directed molecular evolution of a nucleic acid encoding a polypeptide through recombination. This system allows generation of a large population of evolved chimeric sequences, wherein the generated population is significantly enriched for sequences that have a predetermined number of crossover events. A crossover event is a point in a chimeric sequence where a shift in sequence occurs from one parental variant to another parental variant. Such a point is normally at the juncture of where oligonucleotides from two parents are ligated together to form a single sequence. The method allows calculation of the correct concentrations of oligonucleotide sequences so that the final chimeric population of sequences is enriched for the chosen number of crossover events. This provides more control over choosing chimeric variants having a predetermined number of crossover events.

In addition, these methods provide a convenient means for exploring a tremendous amount of the possible protein variant space in comparison to other systems. By using the methods described herein, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

In one aspect, the method creates a chimeric progeny polynucleotide sequence by creating oligonucleotides corresponding to fragments or portions of each parental sequence. Each oligonucleotide preferably includes a unique region of overlap so that mixing the oligonucleotides together results in a new variant that has each oligonucleotide fragment assembled in the correct order. See also U.S. Ser. No. 09/332,835.

Determining Crossover Events

Aspects of the invention include a system and software that receive a desired crossover probability density function (PDF), the number of parent genes to be reassembled, and the number of fragments in the reassembly as inputs. The output of this program is a "fragment PDF" that can be used to determine a recipe for producing reassembled genes, and the estimated crossover PDF of those genes. The processing described herein is preferably performed in MATLAB™ (The Mathworks, Natick, Mass.) a programming language and development environment for technical computing.

Iterative Processes

In practicing the invention, these processes can be iteratively repeated. For example, a nucleic acid (or, the nucleic acid) responsible for an altered or new xylanase phenotype is identified, re-isolated, again modified, re-tested for activity. This process can be iteratively repeated until a desired phenotype is engineered. For example, an entire biochemical anabolic or catabolic pathway can be engineered into a cell, including, e.g., xylanase activity.

Similarly, if it is determined that a particular oligonucleotide has no affect at all on the desired trait (e.g., a new xylanase phenotype), it can be removed as a variable by synthesizing larger parental oligonucleotides that include the sequence to be removed. Since incorporating the sequence within a larger sequence prevents any crossover events, there will no longer be any variation of this sequence in the progeny polynucleotides. This iterative practice of determining which oligonucleotides are most related to the desired trait, and which are unrelated, allows more efficient exploration all of the possible protein variants that might be provide a particular trait or activity.

In vivo Shuffling

In vivo shuffling of molecules is use in methods of the invention that provide variants of polypeptides of the invention, e.g., antibodies, xylanases, and the like. In vivo shuffling can be performed utilizing the natural property of cells to recombine multimers. While recombination in vivo has provided the major natural route to molecular diversity, genetic recombination remains a relatively complex process that involves 1) the recognition of homologies; 2) strand cleavage, strand invasion, and metabolic steps leading to the production of recombinant chiasma; and finally 3) the resolution of chiasma into discrete recombined molecules. The formation of the chiasma requires the recognition of homologous sequences.

In another aspect, the invention includes a method for producing a hybrid polynucleotide from at least a first polynucleotide and a second polynucleotide. The invention can be used to produce a hybrid polynucleotide by introducing at least a first polynucleotide and a second polynucleotide which share at least one region of partial sequence homology (e.g., SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257 and combinations thereof) into a suitable host cell. The regions of partial sequence homology promote processes which result in sequence reorganization producing a hybrid polynucleotide. The term "hybrid polynucleotide", as used herein, is any nucleotide sequence which results from the method of the present invention and contains sequence from at least two original polynucleotide sequences. Such hybrid polynucleotides can result from intermolecular recombination events which promote sequence integration between DNA molecules. In addition, such hybrid polynucleotides can result from intramolecular reductive reassortment processes which utilize repeated sequences to alter a nucleotide sequence within a DNA molecule.

In vivo reassortment is focused on "inter-molecular" processes collectively referred to as "recombination" which in bacteria, is generally viewed as a "RecA-dependent" phenomenon. The invention can rely on recombination processes of a host cell to recombine and re-assort sequences, or the cells' ability to mediate reductive processes to decrease the complexity of quasi-repeated sequences in the cell by deletion. This process of "reductive reassortment" occurs by an "intra-molecular", RecA-independent process.

Therefore, in another aspect of the invention, novel polynucleotides can be generated by the process of reductive reassortment. The method involves the generation of constructs containing consecutive sequences (original encoding sequences), their insertion into an appropriate vector and their subsequent introduction into an appropriate host cell. The reassortment of the individual molecular identities occurs by combinatorial processes between the consecutive sequences in the construct possessing regions of homology, or between quasi-repeated units. The reassortment process recombines and/or reduces the complexity and extent of the repeated sequences and results in the production of novel molecular species. Various treatments may be applied to enhance the rate of reassortment. These could include treatment with ultra-violet light, or DNA damaging chemicals and/or the use of host cell lines displaying enhanced levels of "genetic instability". Thus the reassortment process may involve homologous recombination or the natural property of quasi-repeated sequences to direct their own evolution.

Repeated or "quasi-repeated" sequences play a role in genetic instability. In the present invention, "quasi-repeats" are repeats that are not restricted to their original unit structure. Quasi-repeated units can be presented as an array of sequences in a construct; consecutive units of similar sequences. Once ligated, the junctions between the consecutive sequences become essentially invisible and the quasi-repetitive nature of the resulting construct is now continuous at the molecular level. The deletion process the cell performs to reduce the complexity of the resulting construct operates between the quasi-repeated sequences. The quasi-repeated units provide a practically limitless repertoire of templates upon which slippage events can occur. The constructs containing the quasi-repeats thus effectively provide sufficient molecular elasticity that deletion (and potentially insertion) events can occur virtually anywhere within the quasi-repetitive units.

When the quasi-repeated sequences are all ligated in the same orientation, for instance head to tail or vice versa, the cell cannot distinguish individual units. Consequently, the reductive process can occur throughout the sequences. In contrast, when for example, the units are presented head to head, rather than head to tail, the inversion delineates the endpoints of the adjacent unit so that deletion formation will favor the loss of discrete units. Thus, it is preferable with the present method that the sequences are in the same orientation. Random orientation of quasi-repeated sequences will result in the loss of reassortment efficiency, while consistent orientation of the sequences will offer the highest efficiency. However, while having fewer of the contiguous sequences in the same orientation decreases the efficiency, it may still provide sufficient elasticity for the effective recovery of novel molecules. Constructs can be made with the quasi-repeated sequences in the same orientation to allow higher efficiency.

Sequences can be assembled in a head to tail orientation using any of a variety of methods, including the following:
a) Primers that include a poly-A head and poly-T tail which when made single-stranded would provide orientation can be utilized. This is accomplished by having the first few bases of the primers made from RNA and hence easily removed RNAseH.
b) Primers that include unique restriction cleavage sites can be utilized. Multiple sites, a battery of unique sequences and repeated synthesis and ligation steps would be required.
c) The inner few bases of the primer could be thiolated and an exonuclease used to produce properly tailed molecules.

The recovery of the re-assorted sequences relies on the identification of cloning vectors with a reduced repetitive index (RI). The re-assorted encoding sequences can then be recovered by amplification. The products are re-cloned and expressed. The recovery of cloning vectors with reduced RI can be affected by:
1) The use of vectors only stably maintained when the construct is reduced in complexity.
2) The physical recovery of shortened vectors by physical procedures. In this case, the cloning vector would be recovered using standard plasmid isolation procedures and size fractionated on either an agarose gel, or column with a low molecular weight cut off utilizing standard procedures.
3) The recovery of vectors containing interrupted genes which can be selected when insert size decreases.
4) The use of direct selection techniques with an expression vector and the appropriate selection.

Encoding sequences (for example, genes) from related organisms may demonstrate a high degree of homology and encode quite diverse protein products. These types of sequences are particularly useful in the present invention as quasi-repeats. However, while the examples illustrated below demonstrate the reassortment of nearly identical original encoding sequences (quasi-repeats), this process is not limited to such nearly identical repeats.

The following example demonstrates a method of the invention. Encoding nucleic acid sequences (quasi-repeats) derived from three (3) unique species are described. Each sequence encodes a protein with a distinct set of properties. Each of the sequences differs by a single or a few base pairs at a unique position in the sequence. The quasi-repeated sequences are separately or collectively amplified and ligated into random assemblies such that all possible permutations and combinations are available in the population of ligated molecules. The number of quasi-repeat units can be controlled by the assembly conditions. The average number of quasi-repeated units in a construct is defined as the repetitive index (RI).

Once formed, the constructs may, or may not be size fractionated on an agarose gel according to published protocols, inserted into a cloning vector and transfected into an appropriate host cell. The cells are then propagated and "reductive reassortment" is effected. The rate of the reductive reassortment process may be stimulated by the introduction of DNA damage if desired. Whether the reduction in RI is mediated by deletion formation between repeated sequences by an "intramolecular" mechanism, or mediated by recombination-like events through "inter-molecular" mechanisms is immaterial. The end result is a reassortment of the molecules into all possible combinations.

Optionally, the method comprises the additional step of screening the library members of the shuffled pool to identify individual shuffled library members having the ability to bind or otherwise interact, or catalyze a particular reaction (e.g., such as catalytic domain of an enzyme) with a predetermined macromolecule, such as for example a proteinaceous receptor, an oligosaccharide, virion, or other predetermined compound or structure.

The polypeptides that are identified from such libraries can be used for therapeutic, diagnostic, research and related purposes (e.g., catalysts, solutes for increasing osmolarity of an aqueous solution and the like) and/or can be subjected to one or more additional cycles of shuffling and/or selection.

In another aspect, it is envisioned that prior to or during recombination or reassortment, polynucleotides generated by the method of the invention can be subjected to agents or processes which promote the introduction of mutations into the original polynucleotides. The introduction of such mutations would increase the diversity of resulting hybrid polynucleotides and polypeptides encoded therefrom. The agents or processes which promote mutagenesis can include, but are not limited to: (+)-CC-1065, or a synthetic analog such as (+)-CC-1065-(N-3-Adenine (See Sun and Hurley, (1992); an N-acetylated or deacetylated 4'-fluro-4-aminobiphenyl adduct capable of inhibiting DNA synthesis (See, for example, van de Poll et al. (1992)); or a N-acetylated or deacetylated 4-aminobiphenyl adduct capable of inhibiting DNA synthesis (See also, van de Poll et al. (1992), pp. 751-758); trivalent chromium, a trivalent chromium salt, a polycyclic aromatic hydrocarbon (PAH) DNA adduct capable of inhibiting DNA replication, such as 7-bromomethyl-benz[a] anthracene ("BMA"), tris(2,3-dibromopropyl)phosphate ("Tris-BP"), 1,2-dibromo-3-chloropropane ("DBCP"), 2-bromoacrolein (2BA), benzo[a]pyrene-7,8-dihydrodiol-9-10-epoxide ("BPDE"), a platinum(II) halogen salt, N-hydroxy-2-amino-3-methylimidazo[4,5-f]-quinoline ("N-hydroxy-IQ") and N-hydroxy-2-amino-1-methyl-6-phenylimidazo[4,5-]-pyridine ("N-hydroxy-PhIP"). Exemplary means for slowing or halting PCR amplification consist of UV light (+)-CC-1065 and (+)-CC-1065-(N-3-Adenine). Particularly encompassed means are DNA adducts or polynucleotides comprising the DNA adducts from the polynucleotides or polynucleotides pool, which can be released or removed by a process including heating the solution comprising the polynucleotides prior to further processing.

In another aspect the invention is directed to a method of producing recombinant proteins having biological activity by treating a sample comprising double-stranded template polynucleotides encoding a wild-type protein under conditions according to the invention which provide for the production of hybrid or re-assorted polynucleotides.

Producing Sequence Variants

The invention also provides additional methods for making sequence variants of the nucleic acid (e.g., xylanase) sequences of the invention. The invention also provides additional methods for isolating xylanases using the nucleic acids and polypeptides of the invention. In one aspect, the invention provides for variants of a xylanase coding sequence (e.g., a gene, cDNA or message) of the invention, which can be altered by any means, including, e.g., random or stochastic methods, or, non-stochastic, or "directed evolution," methods, as described above.

The isolated variants may be naturally occurring. Variant can also be created in vitro. Variants may be created using genetic engineering techniques such as site directed mutagenesis, random chemical mutagenesis, Exonuclease III deletion procedures, and standard cloning techniques. Alternatively, such variants, fragments, analogs, or derivatives may be created using chemical synthesis or modification procedures. Other methods of making variants are also familiar to those skilled in the art. These include procedures in which nucleic acid sequences obtained from natural isolates are modified to generate nucleic acids which encode polypeptides having characteristics which enhance their value in industrial or laboratory applications. In such procedures, a large number of variant sequences having one or more nucleotide differences with respect to the sequence obtained from the natural isolate are generated and characterized. These nucleotide differences can result in amino acid changes with respect to the polypeptides encoded by the nucleic acids from the natural isolates.

For example, variants may be created using error prone PCR. In error prone PCR, PCR is performed under conditions where the copying fidelity of the DNA polymerase is low, such that a high rate of point mutations is obtained along the entire length of the PCR product. Error prone PCR is described, e.g., in Leung, D. W., et al., Technique, 1:11-15, 1989) and Caldwell, R. C. & Joyce G. F., PCR Methods Applic., 2:28-33, 1992. Briefly, in such procedures, nucleic acids to be mutagenized are mixed with PCR primers, reaction buffer, $MgCl_2$, $MnCl_2$, Taq polymerase and an appropriate concentration of dNTPs for achieving a high rate of point mutation along the entire length of the PCR product. For example, the reaction may be performed using 20 fmoles of nucleic acid to be mutagenized, 30 pmole of each PCR primer, a reaction buffer comprising 50 mM KCl, 10 mM Tris HCl (pH 8.3) and 0.01% gelatin, 7 mM $MgCl_2$, 0.5 mM $MnCl_2$, 5 units of Taq polymerase, 0.2 mM dGTP, 0.2 mM dATP, 1 mM dCTP, and 1 mM dTTP. PCR may be performed for 30 cycles of 94° C. for 1 min, 45° C. for 1 min, and 72° C. for 1 min. However, it will be appreciated that these parameters may be varied as appropriate. The mutagenized nucleic acids are cloned into an appropriate vector and the activities of the polypeptides encoded by the mutagenized nucleic acids are evaluated.

Variants may also be created using oligonucleotide directed mutagenesis to generate site-specific mutations in any cloned DNA of interest. Oligonucleotide mutagenesis is described, e.g., in Reidhaar-Olson (1988) Science 241:53-57. Briefly, in such procedures a plurality of double stranded oligonucleotides bearing one or more mutations to be introduced into the cloned DNA are synthesized and inserted into the cloned DNA to be mutagenized. Clones containing the mutagenized DNA are recovered and the activities of the polypeptides they encode are assessed.

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction. Assembly PCR is described in, e.g., U.S. Pat. No. 5,965,408.

Still another method of generating variants is sexual PCR mutagenesis. In sexual PCR mutagenesis, forced homologous recombination occurs between DNA molecules of different but highly related DNA sequence in vitro, as a result of random fragmentation of the DNA molecule based on sequence homology, followed by fixation of the crossover by primer extension in a PCR reaction. Sexual PCR mutagenesis is described, e.g., in Stemmer (1994) Proc. Natl. Acad. Sci. USA91:10747-10751. Briefly, in such procedures a plurality of nucleic acids to be recombined are digested with DNase to generate fragments having an average size of 50-200 nucleotides. Fragments of the desired average size are purified and resuspended in a PCR mixture. PCR is conducted under conditions which facilitate recombination between the nucleic acid fragments. For example, PCR may be performed by resuspending the purified fragments at a concentration of 10-30 ng/µl in a solution of 0.2 mM of each dNTP, 2.2 mM $MgCl_2$, 50 mM KCL, 10 mM Tris HCl, pH 9.0, and 0.1% Triton X-100. 2.5 units of Taq polymerase per 100:1 of reaction mixture is added and PCR is performed using the following regime: 94° C. for 60 seconds, 94° C. for 30 seconds, 50-55° C. for 30 seconds, 72° C. for 30 seconds (30-45 times) and 72° C. for 5 minutes. However, it will be appreciated that these parameters may be varied as appropriate. In some aspects, oligonucleotides may be included in the PCR reactions. In other aspects, the Klenow fragment of DNA polymerase I may be used in a first set of PCR reactions and Taq polymerase may be used in a subsequent set of PCR reactions. Recombinant sequences are isolated and the activities of the polypeptides they encode are assessed.

Variants may also be created by in vivo mutagenesis. In some aspects, random mutations in a sequence of interest are generated by propagating the sequence of interest in a bacterial strain, such as an E. coli strain, which carries mutations in one or more of the DNA repair pathways. Such "mutator" strains have a higher random mutation rate than that of a wild-type parent. Propagating the DNA in one of these strains will eventually generate random mutations within the DNA. Mutator strains suitable for use for in vivo mutagenesis are described in PCT Publication No. WO 91/16427, published Oct. 31, 1991, entitled "Methods for Phenotype Creation from Multiple Gene Populations".

Variants may also be generated using cassette mutagenesis. In cassette mutagenesis a small region of a double stranded DNA molecule is replaced with a synthetic oligonucleotide "cassette" that differs from the native sequence. The oligonucleotide often contains completely and/or partially randomized native sequence.

Recursive ensemble mutagenesis may also be used to generate variants. Recursive ensemble mutagenesis is an algorithm for protein engineering (protein mutagenesis) developed to produce diverse populations of phenotypically related mutants whose members differ in amino acid sequence. This method uses a feedback mechanism to control successive rounds of combinatorial cassette mutagenesis. Recursive ensemble mutagenesis is described in Arkin, A. P. and Youvan, D. C., PNAS, USA, 89:7811-7815, 1992.

In some aspects, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described in Delegrave, S. and Youvan, D. C., Biotechnology Research, 11:1548-1552, 1993. Random and site-directed mutagenesis are described in Arnold, F. H., Current Opinion in Biotechnology, 4:450-455, 1993.

In some aspects, the variants are created using shuffling procedures wherein portions of a plurality of nucleic acids which encode distinct polypeptides are fused together to create chimeric nucleic acid sequences which encode chimeric polypeptides as described in U.S. Pat. No. 5,965,408, filed Jul. 9, 1996, entitled, "Method of DNA Reassembly by Interrupting Synthesis" and U.S. Pat. No. 5,939,250, filed May 22, 1996, entitled, "Production of Enzymes Having Desired Activities by Mutagenesis.

The variants of the polypeptides of Group B amino acid sequences may be variants in which one or more of the amino acid residues of the polypeptides of the Group B amino acid sequences are substituted with a conserved or non-conserved amino acid residue (preferably a conserved amino acid residue) and such substituted amino acid residue may or may not be one encoded by the genetic code.

Conservative substitutions are those that substitute a given amino acid in a polypeptide by another amino acid of like characteristics. Typically seen as conservative substitutions are the following replacements: replacements of an aliphatic amino acid such as Alanine, Valine, Leucine and Isoleucine with another aliphatic amino acid; replacement of a Serine with a Threonine or vice versa; replacement of an acidic residue such as Aspartic acid and Glutamic acid with another acidic residue; replacement of a residue bearing an amide group, such as Asparagine and Glutamine, with another residue bearing an amide group; exchange of a basic residue such as Lysine and Arginine with another basic residue; and replacement of an aromatic residue such as Phenylalanine, Tyrosine with another aromatic residue.

Other variants are those in which one or more of the amino acid residues of the polypeptides of the Group B amino acid sequences includes a substituent group.

Still other variants are those in which the polypeptide is associated with another compound, such as a compound to increase the half-life of the polypeptide (for example, polyethylene glycol).

Additional variants are those in which additional amino acids are fused to the polypeptide, such as a leader sequence, a secretory sequence, a proprotein sequence or a sequence which facilitates purification, enrichment, or stabilization of the polypeptide.

In some aspects, the fragments, derivatives and analogs retain the same biological function or activity as the polypeptides of Group B amino acid sequences and sequences substantially identical thereto. In other aspects, the fragment, derivative, or analog includes a proprotein, such that the fragment, derivative, or analog can be activated by cleavage of the proprotein portion to produce an active polypeptide.

Optimizing Codons to Achieve High Levels of Protein Expression in Host Cells

The invention provides methods for modifying xylanase-encoding nucleic acids to modify codon usage. In one aspect, the invention provides methods for modifying codons in a nucleic acid encoding a xylanase to increase or decrease its expression in a host cell. The invention also provides nucleic acids encoding a xylanase modified to increase its expression in a host cell, xylanase so modified, and methods of making the modified xylanases. The method comprises identifying a "non-preferred" or a "less preferred" codon in xylanase-encoding nucleic acid and replacing one or more of these non-preferred or less preferred codons with a "preferred codon" encoding the same amino acid as the replaced codon and at least one non-preferred or less preferred codon in the nucleic acid has been replaced by a preferred codon encoding the same amino acid. A preferred codon is a codon over-represented in coding sequences in genes in the host cell and a non-preferred or less preferred codon is a codon under-represented in coding sequences in genes in the host cell.

Host cells for expressing the nucleic acids, expression cassettes and vectors of the invention include bacteria, yeast, fungi, plant cells, insect cells and mammalian cells. Thus, the invention provides methods for optimizing codon usage in all of these cells, codon-altered nucleic acids and polypeptides made by the codon-altered nucleic acids. Exemplary host cells include gram negative bacteria, such as Escherichia coli and Pseudomonas fluorescens; gram positive bacteria, such as Streptomyces diversa, Lactobacillus gasseri, Lactococcus lactis, Lactococcus cremoris, Bacillus subtilis. Exemplary host cells also include eukaryotic organisms, e.g., various yeast, such as Saccharomyces sp., including Saccharomyces cerevisiae, Schizosaccharomyces pombe, Pichia pastoris, and Kluyveromyces lactis, Hansenula polymorpha, Aspergillus niger, and mammalian cells and cell lines and insect cells and cell lines. Thus, the invention also includes nucleic acids and polypeptides optimized for expression in these organisms and species.

For example, the codons of a nucleic acid encoding a xylanase isolated from a bacterial cell are modified such that the nucleic acid is optimally expressed in a bacterial cell different from the bacteria from which the xylanase was derived, a yeast, a fungi, a plant cell, an insect cell or a mammalian cell. Methods for optimizing codons are well known in the art, see, e.g., U.S. Pat. No. 5,795,737; Baca (2000) Int. J. Parasitol. 30:113-118; Hale (1998) Protein Expr. Purif. 12:185-188; Narum (2001) Infect. Immun. 69:7250-7253. See also Narum (2001) Infect. Immun. 69:7250-7253, describing optimizing codons in mouse systems; Outchkourov (2002) Protein Expr. Purif 24:18-24, describing optimizing codons in yeast; Feng (2000) Biochemistry 39:15399-15409, describing optimizing codons in E. coli; Humphreys (2000) Protein Expr. Purif. 20:252-264, describing optimizing codon usage that affects secretion in E. coli.

Transgenic Non-Human Animals

The invention provides transgenic non-human animals comprising a nucleic acid, a polypeptide (e.g., a xylanase), an expression cassette or vector or a transfected or transformed cell of the invention. The invention also provides methods of making and using these transgenic non-human animals.

The transgenic non-human animals can be, e.g., goats, rabbits, sheep, pigs, cows, rats and mice, comprising the nucleic acids of the invention. These animals can be used, e.g., as in vivo models to study xylanase activity, or, as models to screen for agents that change the xylanase activity in vivo. The coding sequences for the polypeptides to be expressed in the transgenic non-human animals can be designed to be constitutive, or, under, the control of tissue-specific, developmental-specific or inducible transcriptional regulatory factors. Transgenic non-human animals can be designed and generated using any method known in the art; see, e.g., U.S. Pat. Nos. 6,211,428; 6,187,992; 6,156,952; 6,118,044; 6,111, 166; 6,107,541; 5,959,171; 5,922,854; 5,892,070; 5,880,327; 5,891,698; 5,639,940; 5,573,933; 5,387,742; 5,087,571, describing making and using transformed cells and eggs and transgenic mice, rats, rabbits, sheep, pigs and cows. See also, e.g., Pollock (1999) J. Immunol. Methods 231:147-157, describing the production of recombinant proteins in the milk of transgenic dairy animals; Baguisi (1999) Nat. Biotechnol. 17:456-461, demonstrating the production of transgenic goats. U.S. Pat. No. 6,211,428, describes making and using transgenic non-human mammals which express in their brains a nucleic acid construct comprising a DNA sequence. U.S. Pat. No. 5,387,742, describes injecting cloned recombinant or synthetic DNA sequences into fertilized mouse eggs, implanting the injected eggs in pseudo-pregnant females, and growing to term transgenic mice whose cells express proteins related to the pathology of Alzheimer's disease. U.S. Pat. No. 6,187,992, describes making and using a transgenic mouse whose genome comprises a disruption of the gene encoding amyloid precursor protein (APP).

"Knockout animals" can also be used to practice the methods of the invention. For example, in one aspect, the transgenic or modified animals of the invention comprise a "knockout animal," e.g., a "knockout mouse," engineered not to express an endogenous gene, which is replaced with a gene expressing a xylanase of the invention, or, a fusion protein comprising a xylanase of the invention.

Transgenic Plants and Seeds

The invention provides transgenic plants and seeds comprising a nucleic acid, a polypeptide (e.g., a xylanase), an expression cassette or vector or a transfected or transformed cell of the invention. The invention also provides plant products, e.g., oils, seeds, leaves, extracts and the like, comprising a nucleic acid and/or a polypeptide (e.g., a xylanase) of the invention. The transgenic plant can be dicotyledonous (a dicot) or monocotyledonous (a monocot). The invention also provides methods of making and using these transgenic plants and seeds. The transgenic plant or plant cell expressing a polypeptide of the present invention may be constructed in accordance with any method known in the art. See, for example, U.S. Pat. No. 6,309,872.

Nucleic acids and expression constructs of the invention can be introduced into a plant cell by any means. For example, nucleic acids or expression constructs can be introduced into the genome of a desired plant host, or, the nucleic acids or expression constructs can be episomes. Introduction into the genome of a desired plant can be such that the host's xylanase production is regulated by endogenous transcriptional or translational control elements. The invention also provides "knockout plants" where insertion of gene sequence by, e.g., homologous recombination, has disrupted the expression of the endogenous gene. Means to generate "knockout" plants are well-known in the art, see, e.g., Strepp (1998) Proc Natl. Acad. Sci. USA 95:4368-4373; Miao (1995) Plant J 7:359-365. See discussion on transgenic plants, below.

The nucleic acids of the invention can be used to confer desired traits on essentially any plant, e.g., on starch-producing plants, such as potato, wheat, rice, barley, and the like. Nucleic acids of the invention can be used to manipulate metabolic pathways of a plant in order to optimize or alter host's expression of xylanase. The can change xylanase activity in a plant. Alternatively, a xylanase of the invention can be used in production of a transgenic plant to produce a compound not naturally produced by that plant. This can lower production costs or create a novel product.

In one aspect, the first step in production of a transgenic plant involves making an expression construct for expression in a plant cell. These techniques are well known in the art. They can include selecting and cloning a promoter, a coding sequence for facilitating efficient binding of ribosomes to mRNA and selecting the appropriate gene terminator sequences. One exemplary constitutive promoter is CaMV35S, from the cauliflower mosaic virus, which generally results in a high degree of expression in plants. Other promoters are more specific and respond to cues in the plant's internal or external environment. An exemplary light-inducible promoter is the promoter from the cab gene, encoding the major chlorophyll a/b binding protein.

In one aspect, the nucleic acid is modified to achieve greater expression in a plant cell. For example, a sequence of the invention is likely to have a higher percentage of A-T nucleotide pairs compared to that seen in a plant, some of which prefer G-C nucleotide pairs. Therefore, A-T nucleotides in the coding sequence can be substituted with G-C nucleotides without significantly changing the amino acid sequence to enhance production of the gene product in plant cells.

Selectable marker gene can be added to the gene construct in order to identify plant cells or tissues that have successfully integrated the transgene. This may be necessary because achieving incorporation and expression of genes in plant cells is a rare event, occurring in just a few percent of the targeted tissues or cells. Selectable marker genes encode proteins that provide resistance to agents that are normally toxic to plants, such as antibiotics or herbicides. Only plant cells that have integrated the selectable marker gene will survive when grown on a medium containing the appropriate antibiotic or herbicide. As for other inserted genes, marker genes also require promoter and termination sequences for proper function.

In one aspect, making transgenic plants or seeds comprises incorporating sequences of the invention and, optionally, marker genes into a target expression construct (e.g., a plasmid), along with positioning of the promoter and the terminator sequences. This can involve transferring the modified gene into the plant through a suitable method. For example, a construct may be introduced directly into the genomic DNA of the plant cell using techniques such as electroporation and microinjection of plant cell protoplasts, or the constructs can be introduced directly to plant tissue using ballistic methods, such as DNA particle bombardment. For example, see, e.g., Christou (1997) Plant Mol. Biol. 35:197-203; Pawlowski (1996) Mol. Biotechnol. 6:17-30; Klein (1987) Nature 327: 70-73; Takumi (1997) Genes Genet. Syst. 72:63-69, discussing use of particle bombardment to introduce transgenes into wheat; and Adam (1997) supra, for use of particle bombardment to introduce YACs into plant cells. For example, Rinehart (1997) supra, used particle bombardment to generate transgenic cotton plants. Apparatus for accelerating particles is described U.S. Pat. No. 5,015,580; and, the commercially available BioRad (Biolistics) PDS-2000 particle acceleration instrument; see also, John, U.S. Pat. No. 5,608,148; and Ellis, U.S. Pat. No. 5,681,730, describing particle-mediated transformation of gymnosperms.

In one aspect, protoplasts can be immobilized and injected with a nucleic acids, e.g., an expression construct. Although plant regeneration from protoplasts is not easy with cereals, plant regeneration is possible in legumes using somatic embryogenesis from protoplast derived callus. Organized tissues can be transformed with naked DNA using gene gun technique, where DNA is coated on tungsten microprojectiles, shot 1/100th the size of cells, which carry the DNA deep into cells and organelles. Transformed tissue is then induced to regenerate, usually by somatic embryogenesis. This technique has been successful in several cereal species including maize and rice.

Nucleic acids, e.g., expression constructs, can also be introduced in to plant cells using recombinant viruses. Plant cells can be transformed using viral vectors, such as, e.g., tobacco mosaic virus derived vectors (Rouwendal (1997) Plant Mol. Biol. 33:989-999), see Porta (1996) "Use of viral replicons for the expression of genes in plants," Mol. Biotechnol. 5:209-221.

Alternatively, nucleic acids, e.g., an expression construct, can be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria. *Agrobacterium tumefaciens*-mediated transformation techniques, including disarming and use of binary vectors, are well described in the scientific literature. See, e.g., Horsch (1984) *Science* 233:496498; Fraley (1983) *Proc. Natl. Acad. Sci. USA* 80:4803 (1983); *Gene Transfer to Plants*, Potrykus, ed. (Springer-Verlag, Berlin 1995). The DNA in an *A. tumefaciens* cell is contained in the bacterial chromosome as well as in another structure known as a Ti (tumor-inducing) plasmid. The Ti plasmid contains a stretch of DNA termed T-DNA (~20 kb long) that is transferred to the plant cell in the infection process and a series of vir (virulence) genes that direct the infection process. *A. tumefaciens* can only infect a plant through wounds: when a plant root or stem is wounded it gives off certain chemical signals, in response to which, the vir genes of *A. tumefaciens* become activated and direct a series of events necessary for the transfer of the T-DNA from the Ti plasmid to the plant's chromosome. The T-DNA then enters the plant cell through the wound. One speculation is that the T-DNA waits until the plant DNA is being replicated or transcribed, then inserts itself into the exposed plant DNA. In order to use *A. tumefaciens* as a transgene vector, the tumor-inducing section of T-DNA have to be removed, while retaining the T-DNA border regions and the vir genes. The transgene is then inserted between the T-DNA border regions, where it is transferred to the plant cell and becomes integrated into the plant's chromosomes.

The invention provides for the transformation of monocotyledonous plants using the nucleic acids of the invention, including important cereals, see Hiei (1997) Plant Mol. Biol. 35:205-218. See also, e.g., Horsch, Science (1984) 233:496; Fraley (1983) Proc. Natl. Acad. Sci USA 80:4803; Thykjaer (1997) supra; Park (1996) Plant Mol. Biol. 32:1135-1148, discussing T-DNA integration into genomic DNA. See also D'Halluin, U.S. Pat. No. 5,712,135, describing a process for the stable integration of a DNA comprising a gene that is functional in a cell of a cereal, or other monocotyledonous plant.

In one aspect, the third step can involve selection and regeneration of whole plants capable of transmitting the incorporated target gene to the next generation. Such regeneration techniques rely on manipulation of certain phytohormones in a tissue culture growth medium, typically relying on a biocide and/or herbicide marker that has been introduced together with the desired nucleotide sequences. Plant regeneration from cultured protoplasts is described in Evans et al., *Protoplasts Isolation and Culture, Handbook of Plant Cell Culture*, pp. 124-176, MacMillilan Publishing Company, New York, 1983; and Binding, *Regeneration of Plants, Plant Protoplasts*, pp. 21-73, CRC Press, Boca Raton, 1985. Regeneration can also be obtained from plant callus, explants, organs, or parts thereof. Such regeneration techniques are described generally in Klee (1987) Ann. Rev. of Plant Phys. 38:467-486. To obtain whole plants from transgenic tissues such as immature embryos, they can be grown under controlled environmental conditions in a series of media containing nutrients and hormones, a process known as tissue culture. Once whole plants are generated and produce seed, evaluation of the progeny begins.

After the expression cassette is stably incorporated in transgenic plants, it can be introduced into other plants by sexual crossing. Any of a number of standard breeding techniques can be used, depending upon the species to be crossed. Since transgenic expression of the nucleic acids of the invention leads to phenotypic changes, plants comprising the recombinant nucleic acids of the invention can be sexually crossed with a second plant to obtain a final product. Thus, the seed of the invention can be derived from a cross between two transgenic plants of the invention, or a cross between a plant of the invention and another plant. The desired effects (e.g., expression of the polypeptides of the invention to produce a plant in which flowering behavior is altered) can be enhanced when both parental plants express the polypeptides (e.g., a xylanase) of the invention. The desired effects can be passed to future plant generations by standard propagation means.

The nucleic acids and polypeptides of the invention are expressed in or inserted in any plant or seed. Transgenic plants of the invention can be dicotyledonous or monocotyledonous. Examples of monocot transgenic plants of the invention are grasses, such as meadow grass (blue grass, *Poa*), forage grass such as *festuca, lolium*, temperate grass, such as *Agrostis*, and cereals, e.g., wheat, oats, rye, barley, rice, sorghum, and maize (corn). Examples of dicot transgenic plants of the invention are tobacco, legumes, such as lupins, potato, sugar beet, pea, bean and soybean, and cruciferous plants (family Brassicaceae), such as cauliflower, rape seed, and the closely related model organism *Arabidopsis thaliana*. Thus, the transgenic plants and seeds of the invention include a broad range of plants, including, but not limited to, species from the genera *Anacardium, Arachis, Asparagus, Atropa, Avena, Brassica*, Citrus, *Citrullus, Capsicum, Carthamus*, Cocos, *Coffea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus, Manihot, Majorana, Medicago, Nicotiana, Olea, Oryza, Panieum, Pannisetum, Persea, Phaseolus, Pistachia, Pisum, Pyrus, Prunus, Raphanus, Ricinus, Secale, Senecio, Sinapis, Solanum, Sorghum, Theobromus, Trigonella, Triticum, Vicia, Vitis, Vigna*, and *Zea*.

In alternative embodiments, the nucleic acids of the invention are expressed in plants which contain fiber cells, including, e.g., cotton, silk cotton tree (Kapok, Ceiba pentandra), desert willow, creosote bush, winterfat, balsa, ramie, kenaf, hemp, roselle, jute, sisal abaca and flax. In alternative embodiments, the transgenic plants of the invention can be members of the genus *Gossypium*, including members of any *Gossypium* species, such as *G. arboreum; G. herbaceum, G. barbadense*, and *G. hirsutum*.

The invention also provides for transgenic plants to be used for producing large amounts of the polypeptides (e.g., a xylanase or antibody) of the invention. For example, see Palmgren (1997) Trends Genet. 13:348; Chong (1997) Transgenic Res. 6:289-296 (producing human milk protein beta-casein in transgenic potato plants using an auxin-inducible, bidirectional mannopine synthase (mas 1',2') promoter with *Agrobacterium tumefaciens*-mediated leaf disc transformation methods).

Using known procedures, one of skill can screen for plants of the invention by detecting the increase or decrease of transgene mRNA or protein in transgenic plants. Means for detecting and quantitation of mRNAs or proteins are well known in the art.

Polypeptides and Peptides

In one aspect, the invention provides isolated or recombinant polypeptides having a sequence identity (e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity) to an exemplary sequence of the invention, e.g., proteins having a sequence as set forth in SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ BD NO:120, SEQ ID NO:122, SEQ ID NO:124, SEQ ID NO:126, SEQ ID NO:128, SEQ ID NO:130, SEQ ID NO:132; SEQ ID NO:134; SEQ ID NO:136; SEQ ID NO:138; SEQ ID NO:140; SEQ ID NO:142; SEQ ID NO:144; NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, SEQ ID NO:322, SEQ ID NO:324, SEQ ID NO:326, SEQ ID NO:328, SEQ ID NO:330, SEQ ID NO:332, SEQ ID NO:334, SEQ ID NO:336, SEQ ID NO:338, SEQ ID NO:340, SEQ ID NO:342, SEQ ID NO:344, SEQ ID NO:346, SEQ ID NO:348, SEQ ID NO:350, SEQ ID NO:352, SEQ ID NO:354, SEQ ID NO:356, SEQ ID NO:358, SEQ ID NO:360, SEQ ID NO:362, SEQ ID NO:364, SEQ ID NO:366, SEQ ID NO:368, SEQ ID NO:370, SEQ ID NO:372, SEQ ID NO:374, SEQ ID NO:376, SEQ ID NO:378 or SEQ ID NO:380. In one aspect, the polypeptide has a xylanase activity, e.g., can hydrolyze a glycosidic bond in a polysaccharide, e.g., a xylan. In one aspect, the polypeptide has a xylanase activity comprising catalyzing hydrolysis of internal $\beta$-1,4-xylosidic linkages. In one aspect, the xylanase activity comprises an endo-1,4-beta-xylanase activity. In one aspect, the xylanase activity comprises hydrolyzing a xylan to produce a smaller molecular weight xylose and xylo-oligomer. In one aspect, the xylan comprises an arabinoxylan, such as a water soluble arabinoxylan.

The polypeptides of the invention include xylanases in an active or inactive form. For example, the polypeptides of the invention include proproteins before "maturation" or processing of prepro sequences, e.g., by a proprotein-processing enzyme, such as a proprotein convertase to generate an "active" mature protein. The polypeptides of the invention include xylanases inactive for other reasons, e.g., before "activation" by a post-translational processing event, e.g., an endo- or exo-peptidase or proteinase action, a phosphorylation event, an amidation, a glycosylation or a sulfation, a dimerization event, and the like. The polypeptides of the invention include all active forms, including active subsequences, e.g., catalytic domains or active sites, of the xylanase.

Methods for identifying "prepro" domain sequences and signal sequences are well known in the art, see, e.g., Van de Ven (1993) Crit. Rev. Oncog. 4(2):115-136. For example, to identify a prepro sequence, the protein is purified from the extracellular space and the N-terminal protein sequence is determined and compared to the unprocessed form.

The invention includes polypeptides with or without a signal sequence and/or a prepro sequence. The invention includes polypeptides with heterologous signal sequences and/or prepro sequences. The prepro sequence (including a sequence of the invention used as a heterologous prepro domain) can be located on the amino terminal or the carboxy terminal end of the protein. The invention also includes isolated or recombinant signal sequences, prepro sequences and catalytic domains (e.g., "active sites") comprising sequences of the invention.

The percent sequence identity can be over the full length of the polypeptide, or, the identity can be over a region of at least about 50, 60, 70, 80, 90, 100, 150, 200, 250, 300, 350, 400, 450, 500, 550, 600, 650, 700 or more residues. Polypeptides of the invention can also be shorter than the full length of exemplary polypeptides. In alternative aspects, the invention provides polypeptides (peptides, fragments) ranging in size between about 5 and the full length of a polypeptide, e.g., an enzyme, such as a xylanase; exemplary sizes being of about 5, 10, 15, 20, 25, 30, 35, 40, 45, 50, 55, 60, 65, 70, 75, 80, 85, 90, 100, 125, 150, 175, 200, 250, 300, 350, 400, 450, 500, 550, 600, 650, 700, or more residues, e.g., contiguous residues of an exemplary xylanase of the invention.

Peptides of the invention (e.g., a subsequence of an exemplary polypeptide of the invention) can be useful as, e.g., labeling probes, antigens, toleragens, motifs, xylanase active sites (e.g., "catalytic domains"), signal sequences and/or prepro domains.

Polypeptides and peptides of the invention can be isolated from natural sources, be synthetic, or be recombinantly generated polypeptides. Peptides and proteins can be recombinantly expressed in vitro or in vivo. The peptides and polypeptides of the invention can be made and isolated using any method known in the art. Polypeptide and peptides of the invention can also be synthesized, whole or in part, using chemical methods well known in the art. See e.g., Caruthers (1980) Nucleic Acids Res. Symp. Ser. 215-223; Horn (1980) Nucleic Acids Res. Symp. Ser. 225-232; Banga, A. K., Therapeutic Peptides and Proteins, Formulation, Processing and Delivery Systems (1995) Technomic Publishing Co., Lancaster, Pa. For example, peptide synthesis can be performed using various solid-phase techniques (see e.g., Roberge (1995) Science 269:202; Merrifield (1997) Methods Enzymol. 289:3-13) and automated synthesis may be achieved, e.g., using the ABI 431A Peptide Synthesizer (Perkin Elmer) in accordance with the instructions provided by the manufacturer.

The peptides and polypeptides of the invention can also be glycosylated. The glycosylation can be added post-translationally either chemically or by cellular biosynthetic mechanisms, wherein the later incorporates the use of known glycosylation motifs, which can be native to the sequence or can be added as a peptide or added in the nucleic acid coding sequence. The glycosylation can be O-linked or N-linked.

The peptides and polypeptides of the invention, as defined above, include all "mimetic" and "peptidomimetic" forms. The terms "mimetic" and "peptidomimetic" refer to a synthetic chemical compound which has substantially the same structural and/or functional characteristics of the polypeptides of the invention. The mimetic can be either entirely composed of synthetic, non-natural analogues of amino acids, or, is a chimeric molecule of partly natural peptide amino acids and partly non-natural analogs of amino acids. The mimetic can also incorporate any amount of natural amino acid conservative substitutions as long as such substitutions also do not substantially alter the mimetic's structure and/or activity. As with polypeptides of the invention which are conservative variants, routine experimentation will determine whether a mimetic is within the scope of the invention, i.e., that its structure and/or function is not substantially altered. Thus, in one aspect, a mimetic composition is within the scope of the invention if it has a xylanase activity.

Polypeptide mimetic compositions of the invention can contain any combination of non-natural structural components. In alternative aspect, mimetic compositions of the invention include one or all of the following three structural groups: a) residue linkage groups other than the natural amide bond ("peptide bond") linkages; b) non-natural residues in place of naturally occurring amino acid residues; or c) residues which induce secondary structural mimicry, i.e., to induce or stabilize a secondary structure, e.g., a beta turn, gamma turn, beta sheet, alpha helix conformation, and the like. For example, a polypeptide of the invention can be characterized as a mimetic when all or some of its residues are joined by chemical means other than natural peptide bonds. Individual peptidomimetic residues can be joined by peptide bonds, other chemical bonds or coupling means, such as, e.g., glutaraldehyde, N-hydroxysuccinimide esters, bifunctional maleimides, N,N'-dicyclohexylcarbodiimide (DCC) or N,N'-diisopropylcarbodiimide (DIC). Linking groups that can be an alternative to the traditional amide bond ("peptide bond") linkages include, e.g., ketomethylene (e.g., —C(=O)—$CH_2$— for —C(=O)—NH—), aminomethylene ($CH_2$—NH), ethylene, olefin (CH=CH), ether ($CH_2$—O), thioether ($CH_2$—S), tetrazole (CN4—), thiazole, retroamide, thioamide, or ester (see, e.g., Spatola (1983) in Chemistry and Biochemistry of Amino Acids, Peptides and Proteins, Vol. 7, pp 267-357, "Peptide Backbone Modifications," Marcell Dekker, NY).

A polypeptide of the invention can also be characterized as a mimetic by containing all or some non-natural residues in place of naturally occurring amino acid residues. Non-natural residues are well described in the scientific and patent literature; a few exemplary non-natural compositions useful as mimetics of natural amino acid residues and guidelines are described below. Mimetics of aromatic amino acids can be generated by replacing by, e.g., D- or L-naphylalanine; D- or L-phenylglycine; D- or L-2 thieneylalanine; D- or L-1, -2,3-, or 4 pyreneylalanine; D- or L-3 thieneylalanine; D- or L-(2-pyridinyl)-alanine; D- or L-(3-pyridinyl)-alanine; D- or L-(2-pyrazinyl)-alanine; D- or L-(4-isopropyl)-phenylglycine; D-(trifluoromethyl)-phenylglycine; D-(trifluoromethyl)-phenylalanine; D-p-fluoro-phenylalanine; D- or L-p-biphenylphenylalanine; D- or L-p-methoxy-biphenylphenylalanine; D- or L-2-indole(alkyl)alanines; and, D- or L-alkylainines, where alkyl can be substituted or unsubstituted methyl, ethyl, propyl, hexyl, butyl, pentyl, isopropyl, iso-butyl, sec-isotyl, iso-pentyl, or a non-acidic amino acids. Aromatic rings of a non-natural amino acid include, e.g., thiazolyl, thiophenyl, pyrazolyl, benzimidazolyl, naphthyl, furanyl, pyrrolyl, and pyridyl aromatic rings.

Mimetics of acidic amino acids can be generated by substitution by, e.g., non-carboxylate amino acids while maintaining a negative charge; (phosphono)alanine; sulfated threonine. Carboxyl side groups (e.g., aspartyl or glutamyl) can also be selectively modified by reaction with carbodiimides (R'—N—C—N—R') such as, e.g., 1-cyclohexyl-3(2-morpholinyl-(4-ethyl) carbodiimide or 1-ethyl-3(4-azonia-4,4-dimetholpentyl) carbodiimide. Aspartyl or glutamyl can also be converted to asparaginyl and glutaminyl residues by reaction with ammonium ions. Mimetics of basic amino acids can be generated by substitution with, e.g., (in addition to lysine and arginine) the amino acids ornithine, citrulline, or (guanidino)-acetic acid, or (guanidino)alkyl-acetic acid, where alkyl is defined above. Nitrile derivative (e.g., containing the CN-moiety in place of COOH) can be substituted for asparagine or glutamine. Asparaginyl and glutaminyl residues can be deaminated to the corresponding aspartyl or glutamyl residues. Arginine residue mimetics can be generated by reacting arginyl with, e.g., one or more conventional reagents, including, e.g., phenylglyoxal, 2,3-butanedione, 1,2-cyclo-hexanedione, or ninhydrin, preferably under alkaline conditions. Tyrosine residue mimetics can be generated by reacting tyrosyl with, e.g., aromatic diazonium compounds or tetranitromethane. N-acetylimidizol and tetranitromethane can be used to form O-acetyl tyrosyl species and 3-nitro derivatives, respectively. Cysteine residue mimetics can be generated by reacting cysteinyl residues with, e.g., alpha-haloacetates such as 2-chloroacetic acid or chloroacetamide and corresponding amines; to give carboxymethyl or carboxyamidomethyl derivatives. Cysteine residue mimetics can also be generated by reacting cysteinyl residues with, e.g., bromo-trifluoroacetone, alpha-bromo-beta-(5-imidozoyl) propionic acid; chloroacetyl phosphate, N-alkylmaleimides, 3-nitro-2-pyridyl disulfide; methyl 2-pyridyl disulfide; p-chloromercuribenzoate; 2-chloromercuri-4 nitrophenol; or, chloro-7-nitrobenzo-oxa-1,3-diazole. Lysine mimetics can be generated (and amino terminal residues can be altered) by reacting lysinyl with, e.g., succinic or other carboxylic acid anhydrides. Lysine and other alpha-amino-containing residue mimetics can also be generated by reaction with imidoesters, such as methyl picolinimidate, pyridoxal phosphate, pyridoxal, chloroborohydride, trinitro-benzenesulfonic acid, O-methylisourea, 2,4, pentanedione, and transamidase-catalyzed reactions with glyoxylate. Mimetics of methionine can be generated by reaction with, e.g., methionine sulfoxide. Mimetics of proline include, e.g., pipecolic acid, thiazolidine carboxylic acid, 3- or 4 hydroxy proline, dehydroproline, 3- or 4-methylproline, or 3,3,-dimethylproline. Histidine residue mimetics can be generated by reacting histidyl with, e.g., diethylprocarbonate or para-bromophenacyl bromide. Other mimetics include, e.g., those generated by hydroxylation of proline and lysine; phosphorylation of the hydroxyl groups of seryl or threonyl residues; methylation of the alpha-amino groups of lysine, arginine and histidine; acetylation of the N-terminal amine; methylation of main chain amide residues or substitution with N-methyl amino acids; or amidation of C-terminal carboxyl groups.

A residue, e.g., an amino acid, of a polypeptide of the invention can also be replaced by an amino acid (or peptidomimetic residue) of the opposite chirality. Thus, any amino acid naturally occurring in the L-configuration (which can also be referred to as the R or S, depending upon the structure of the chemical entity) can be replaced with the amino acid of the same chemical structural type or a peptidomimetic, but of the opposite chirality, referred to as the D-amino acid, but also can be referred to as the R- or S-form.

The invention also provides methods for modifying the polypeptides of the invention by either natural processes, such as post-translational processing (e.g., phosphorylation, acylation, etc), or by chemical modification techniques, and the resulting modified polypeptides. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphatidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, proteolytic processing, phosphorylation, prenylation, racemization, selenoylation, sulfation, and transfer-RNA mediated addition of amino acids to protein such as arginylation. See, e.g., Creighton, T. E., Proteins—Structure and Molecular Properties 2nd Ed., W.H. Freeman and Company, New York (1993); Posttranslational Covalent Modification of Proteins, B. C. Johnson, Ed., Academic Press, New York, pp. 1-12 (1983).

Solid-phase chemical peptide synthesis methods can also be used to synthesize the polypeptide or fragments of the invention. Such method have been known in the art since the early 1960's (Merrifield, R. B., J. Am. Chem. Soc., 85:2149-2154, 1963) (See also Stewart, J. M. and Young, J. D., Solid Phase Peptide Synthesis, 2nd Ed., Pierce Chemical Co., Rockford, Ill., pp. 11-12)) and have recently been employed in commercially available laboratory peptide design and synthesis kits (Cambridge Research Biochemicals). Such commercially available laboratory kits have generally utilized the teachings of H. M. Geysen et al, Proc. Natl. Acad. Sci., USA, 81:3998 (1984) and provide for synthesizing peptides upon the tips of a multitude of "rods" or "pins" all of which are connected to a single plate. When such a system is utilized, a plate of rods or pins is inverted and inserted into a second plate of corresponding wells or reservoirs, which contain solutions for attaching or anchoring an appropriate amino acid to the pin's or rod's tips. By repeating such a process step, i.e., inverting and inserting the rod's and pin's tips into appropriate solutions, amino acids are built into desired peptides. In addition, a number of available FMOC peptide synthesis systems are available. For example, assembly of a polypeptide or fragment can be carried out on a solid support using an Applied Biosystems, Inc. Model 431A™ automated peptide synthesizer. Such equipment provides ready access to the peptides of the invention, either by direct synthesis or by synthesis of a series of fragments that can be coupled using other known techniques.

The invention includes xylanases of the invention with and without signal. The polypeptide comprising a signal sequence of the invention can be a xylanase of the invention or another xylanase or another enzyme or other polypeptide.

The invention includes immobilized xylanases, anti-xylanase antibodies and fragments thereof. The invention provides methods for inhibiting xylanase activity, e.g., using dominant negative mutants or anti-xylanase antibodies of the invention. The invention includes heterocomplexes, e.g., fusion proteins, heterodimers, etc., comprising the xylanases of the invention.

Polypeptides of the invention can have a xylanase activity under various conditions, e.g., extremes in pH and/or temperature, oxidizing agents, and the like. The invention provides methods leading to alternative xylanase preparations with different catalytic efficiencies and stabilities, e.g., towards temperature, oxidizing agents and changing wash conditions. In one aspect, xylanase variants can be produced using techniques of site-directed mutagenesis and/or random mutagenesis. In one aspect, directed evolution can be used to produce a great variety of xylanase variants with alternative specificities and stability.

The proteins of the invention are also useful as research reagents to identify xylanase modulators, e.g., activators or inhibitors of xylanase activity. Briefly, test samples (compounds, broths, extracts, and the like) are added to xylanase assays to determine their ability to inhibit substrate cleavage. Inhibitors identified in this way can be used in industry and research to reduce or prevent undesired proteolysis. As with xylanases, inhibitors can be combined to increase the spectrum of activity.

The enzymes of the invention are also useful as research reagents to digest proteins or in protein sequencing. For example, the xylanases may be used to break polypeptides into smaller fragments for sequencing using, e.g. an automated sequencer.

The invention also provides methods of discovering new xylanases using the nucleic acids, polypeptides and antibodies of the invention. In one aspect, phagemid libraries are screened for expression-based discovery of xylanases. In another aspect, lambda phage libraries are screened for expression-based discovery of xylanases. Screening of the phage or phagemid libraries can allow the detection of toxic clones; improved access to substrate; reduced need for engineering a host, by-passing the potential for any bias resulting from mass excision of the library; and, faster growth at low clone densities. Screening of phage or phagemid libraries can be in liquid phase or in solid phase. In one aspect, the invention provides screening in liquid phase. This gives a greater flexibility in assay conditions; additional substrate flexibility; higher sensitivity for weak clones; and ease of automation over solid phase screening.

The invention provides screening methods using the proteins and nucleic acids of the invention and robotic automation to enable the execution of many thousands of biocatalytic reactions and screening assays in a short period of time, e.g., per day, as well as ensuring a high level of accuracy and reproducibility (see discussion of arrays, below). As a result, a library of derivative compounds can be produced in a matter of weeks. For further teachings on modification of molecules, including small molecules, see PCT/US94/09174.

Another aspect of the invention is an isolated or purified polypeptide comprising the sequence of one of Group A nucleic acid sequences and sequences substantially identical thereto, or fragments comprising at least about 5, 10, 15, 20, 25, 30, 35, 40, 50, 75, 100, or 150 consecutive amino acids thereof. As discussed above, such polypeptides may be obtained by inserting a nucleic acid encoding the polypeptide into a vector such that the coding sequence is operably linked to a sequence capable of driving the expression of the encoded polypeptide in a suitable host cell. For example, the expression vector may comprise a promoter, a ribosome binding site for translation initiation and a transcription terminator. The vector may also include appropriate sequences for amplifying expression.

Another aspect of the invention is polypeptides or fragments thereof which have at least about 50%, at least about 55%, at least about 60%, at least about 65%, at least about 70%, at least about 75%, at least about 80%, at least about 85%, at least about 90%, at least about 95%, or more than about 95% homology to one of the polypeptides of Group B amino acid sequences and sequences substantially identical thereto, or a fragment comprising at least 5, 10, 15, 20, 25, 30, 35, 40, 50, 75, 100, or 150 consecutive amino acids thereof. Homology may be determined using any of the programs described above which aligns the polypeptides or fragments being compared and determines the extent of amino acid identity or similarity between them. It will be appreciated that amino acid "homology" includes conservative amino acid substitutions such as those described above.

The polypeptides or fragments having homology to one of the polypeptides of Group B amino acid sequences and sequences substantially identical thereto, or a fragment comprising at least about 5, 10, 15, 20, 25, 30, 35, 40, 50, 75, 100, or 150 consecutive amino acids thereof may be obtained by isolating the nucleic acids encoding them using the techniques described above.

Alternatively, the homologous polypeptides or fragments may be obtained through biochemical enrichment or purification procedures. The sequence of potentially homologous polypeptides or fragments may be determined by xylan hydrolase digestion, gel electrophoresis and/or microsequencing. The sequence of the prospective homologous polypeptide or fragment can be compared to one of the polypeptides of Group B amino acid sequences and sequences substantially identical thereto, or a fragment comprising at least about 5, 10, 15, 20, 25, 30, 35, 40, 50, 75, 100, or 150 consecutive amino acids thereof using any of the programs described above.

Another aspect of the invention is an assay for identifying fragments or variants of Group B amino acid sequences and sequences substantially identical thereto, which retain the enzymatic function of the polypeptides of Group B amino acid sequences and sequences substantially identical thereto. For example the fragments or variants of said polypeptides, may be used to catalyze biochemical reactions, which indicate that the fragment or variant retains the enzymatic activity of the polypeptides in the Group B amino acid sequences.

The assay for determining if fragments of variants retain the enzymatic activity of the polypeptides of Group B amino acid sequences and sequences substantially identical thereto includes the steps of: contacting the polypeptide fragment or variant with a substrate molecule under conditions which allow the polypeptide fragment or variant to function and detecting either a decrease in the level of substrate or an increase in the level of the specific reaction product of the reaction between the polypeptide and substrate.

The polypeptides of Group B amino acid sequences and sequences substantially identical thereto or fragments comprising at least 5, 10, 15, 20, 25, 30, 35, 40, 50, 75, 100, or 150 consecutive amino acids thereof may be used in a variety of applications. For example, the polypeptides or fragments thereof may be used to catalyze biochemical reactions. In accordance with one aspect of the invention, there is provided a process for utilizing the polypeptides of Group B amino acid sequences and sequences substantially identical thereto or polynucleotides encoding such polypeptides for hydrolyzing glycosidic linkages. In such procedures, a substance containing a glycosidic linkage (e.g., a starch) is contacted with one of the polypeptides of Group B amino acid sequences, or sequences substantially identical thereto under conditions which facilitate the hydrolysis of the glycosidic linkage.

The present invention exploits the unique catalytic properties of enzymes. Whereas the use of biocatalysts (i.e., purified or crude enzymes, non-living or living cells) in chemical transformations normally requires the identification of a particular biocatalyst that reacts with a specific starting compound, the present invention uses selected biocatalysts and reaction conditions that are specific for functional groups that are present in many starting compounds, such as small molecules. Each biocatalyst is specific for one functional group, or several related functional groups and can react with many starting compounds containing this functional group.

The biocatalytic reactions produce a population of derivatives from a single starting compound. These derivatives can be subjected to another round of biocatalytic reactions to produce a second population of derivative compounds. Thousands of variations of the original small molecule or compound can be produced with each iteration of biocatalytic derivatization.

Enzymes react at specific sites of a starting compound without affecting the rest of the molecule, a process which is very difficult to achieve using traditional chemical methods. This high degree of biocatalytic specificity provides the means to identify a single active compound within the library. The library is characterized by the series of biocatalytic reactions used to produce it, a so called "biosynthetic history". Screening the library for biological activities and tracing the biosynthetic history identifies the specific reaction sequence producing the active compound. The reaction sequence is repeated and the structure of the synthesized compound determined. This mode of identification, unlike other synthesis and screening approaches, does not require immobilization technologies and compounds can be synthesized and tested free in solution using virtually any type of screening assay. It is important to note, that the high degree of specificity of enzyme reactions on functional groups allows for the "tracking" of specific enzymatic reactions that make up the biocatalytically produced library.

Many of the procedural steps are performed using robotic automation enabling the execution of many thousands of biocatalytic reactions and screening assays per day as well as ensuring a high level of accuracy and reproducibility. As a result, a library of derivative compounds can be produced in a matter of weeks which would take years to produce using current chemical methods.

In a particular aspect, the invention provides a method for modifying small molecules, comprising contacting a polypeptide encoded by a polynucleotide described herein or enzymatically active fragments thereof with a small molecule to produce a modified small molecule. A library of modified small molecules is tested to determine if a modified small molecule is present within the library which exhibits a desired activity. A specific biocatalytic reaction which produces the modified small molecule of desired activity is identified by systematically eliminating each of the biocatalytic reactions used to produce a portion of the library and then testing the small molecules produced in the portion of the library for the presence or absence of the modified small molecule with the desired activity. The specific biocatalytic reactions which produce the modified small molecule of desired activity is optionally repeated. The biocatalytic reactions are conducted with a group of biocatalysts that react with distinct structural moieties found within the structure of a small molecule, each biocatalyst is specific for one structural moiety or a group of related structural moieties; and each biocatalyst reacts with many different small molecules which contain the distinct structural moiety.

Xylanase Signal Sequences, Prepro and Catalytic Domains

The invention provides xylanase signal sequences (e.g., signal peptides (SPs)), prepro domains and catalytic domains (CDs). The SPs, prepro domains and/or CDs of the invention can be isolated or recombinant peptides or can be part of a fusion protein, e.g., as a heterologous domain in a chimeric protein. The invention provides nucleic acids encoding these catalytic domains (CDs), prepro domains and signal sequences (SPs, e.g., a peptide having a sequence comprising/consisting of amino terminal residues of a polypeptide of the invention). In one aspect, the invention provides a signal sequence comprising a peptide comprising/consisting of a sequence as set forth in residues 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30, 1 to 31, 1 to 32, 1 to 33, 1 to 34, 1 to 35, 1 to 36, 1 to 37, 1 to 38, 1 to 39, 1 to 40, 1 to 41, 1 to 42, 1 to 43, 1 to 44 of a polypeptide of the invention.

In one aspect, the invention provides a signal sequence comprising a peptide comprising/consisting of a sequence as set forth in Table 4 below. For example, in reading Table 4, the invention provides a signal sequence comprising/consisting of residues 1 to 23 of SEQ ID NO:102 (encoded by SEQ ID NO:101), a signal sequence comprising/consisting of residues 1 to 41 of SEQ ID NO:104 (encoded by SEQ ID NO:103), etc.

TABLE 4 exemplary signal sequences of the invention

| SEQ ID NO: | Signal sequence (amino acid positions) |
|---|---|
| 101, 102 | 1-23 |
| 103, 104 | 1-41 |
| 105, 106 | 1-22 |
| 109, 110 | 1-26 |
| 11, 12 | 1-28 |
| 113, 114 | 1-28 |
| 119, 120 | 1-33 |
| 121, 122 | 1-20 |
| 123, 124 | 1-20 |
| 131, 132 | 1-26 |
| 135, 136 | 1-25 |
| 139, 140 | 1-24 |
| 141, 142 | 1-25 |
| 143, 144 | 1-32 |
| 147, 148 | 1-28 |
| 149, 150 | 1-18 |
| 15, 16 | 1-20 |
| 151, 152 | 1-21 |
| 153, 154 | 1-16 |
| 155, 156 | 1-21 |
| 157, 158 | 1-29 |
| 159, 160 | 1-23 |
| 161, 162 | 1-32 |
| 163, 164 | 1-26 |
| 165, 166 | 1-23 |
| 167, 168 | 1-36 |
| 169, 170 | 1-24 |
| 17, 18 | 1-31 |
| 171, 172 | 1-29 |
| 173, 174 | 1-22 |
| 175, 176 | 1-27 |
| 177, 178 | 1-26 |
| 179, 180 | 1-19 |
| 181, 182 | 1-25 |
| 183, 184 | 1-32 |
| 185, 186 | 1-27 |
| 187, 188 | 1-28 |
| 19, 20 | 1-29 |
| 191, 192 | 1-27 |
| 193, 194 | 1-21 |
| 195, 196 | 1-23 |
| 197, 198 | 1-28 |
| 199, 200 | 1-30 |
| 203, 204 | 1-30 |
| 205, 206 | 1-29 |
| 207, 208 | 1-27 |
| 209, 210 | 1-25 |
| 21, 22 | 1-28 |
| 211, 212 | 1-29 |
| 215, 216 | 1-31 |
| 217, 218 | 1-29 |
| 219, 220 | 1-23 |
| 221, 222 | 1-24 |
| 223, 224 | 1-28 |
| 225, 226 | 1-25 |
| 227, 228 | 1-39 |
| 229, 230 | 1-28 |
| 23, 24 | 1-29 |
| 231, 232 | 1-41 |
| 233, 234 | 1-26 |
| 235, 236 | 1-28 |
| 237, 238 | 1-32 |

TABLE 4-continued exemplary signal sequences of the invention

| SEQ ID NO: | Signal sequence (amino acid positions) |
|---|---|
| 239, 240 | 1-30 |
| 241, 242 | 1-28 |
| 243, 244 | 1-33 |
| 245, 246 | 1-32 |
| 249, 250 | 1-33 |
| 253, 254 | 1-24 |
| 255, 256 | 1-51 |
| 259, 260 | 1-24 |
| 261, 262 | 1-26 |
| 263, 264 | 1-29 |
| 267, 268 | 1-30 |
| 27, 28 | 1-27 |
| 271, 272 | 1-22 |
| 273, 274 | 1-74 |
| 277, 278 | 1-19 |
| 279, 280 | 1-22 |
| 283, 284 | 1-28 |
| 287, 288 | 1-23 |
| 289, 290 | 1-22 |
| 295, 296 | 1-26 |
| 299, 300 | 1-24 |
| 301, 302 | 1-28 |
| 303, 304 | 1-74 |
| 305, 306 | 1-32 |
| 309, 310 | 1-20 |
| 311, 312 | 1-33 |
| 313, 314 | 1-22 |
| 315, 316 | 1-28 |
| 319, 320 | 1-27 |
| 325, 326 | 1-27 |
| 327, 328 | 1-29 |
| 329, 330 | 1-35 |
| 33, 34 | 1-23 |
| 331, 332 | 1-28 |
| 333, 334 | 1-30 |
| 335, 336 | 1-50 |
| 339, 340 | 1-23 |
| 341, 342 | 1-45 |
| 347, 348 | 1-20 |
| 349, 350 | 1-20 |
| 351, 352 | 1-73 |
| 353, 354 | 1-18 |
| 355, 356 | 1-21 |
| 357, 358 | 1-25 |
| 359, 360 | 1-31 |
| 361, 362 | 1-26 |
| 365, 366 | 1-65 |
| 367, 368 | 1-23 |
| 369, 370 | 1-27 |
| 39, 40 | 1-24 |
| 41, 42 | 1-37 |
| 45, 46 | 1-25 |
| 47, 48 | 1-26 |
| 5, 6 | 1-47 |
| 51, 52 | 1-30 |
| 53, 54 | 1-37 |
| 55, 56 | 1-24 |
| 57, 58 | 1-22 |
| 59, 60 | 1-21 |
| 63, 64 | 1-20 |
| 65, 66 | 1-22 |
| 67, 68 | 1-28 |
| 69, 70 | 1-25 |
| 7, 8 | 1-57 |
| 73, 74 | 1-21 |
| 75, 76 | 1-22 |
| 77, 78 | 1-27 |
| 79, 80 | 1-36 |
| 83, 84 | 1-30 |
| 87, 88 | 1-29 |
| 89, 90 | 1-40 |
| 9, 10 | 1-36 |

TABLE 4-continued exemplary signal sequences of the invention

| SEQ ID NO: | Signal sequence (amino acid positions) |
|---|---|
| 95, 96 | 1-24 |
| 99, 100 | 1-33 |

The xylanase signal sequences (SPs) and/or prepro sequences of the invention can be isolated peptides, or, sequences joined to another xylanase or a non-xylanase polypeptide, e.g., as a fusion (chimeric) protein. In one aspect, the invention provides polypeptides comprising xylanase signal sequences of the invention. In one aspect, polypeptides comprising xylanase signal sequences SPs and/or prepro of the invention comprise sequences heterologous to a xylanase of the invention (e.g., a fusion protein comprising an SP and/or prepro of the invention and sequences from another xylanase or a non-xylanase protein). In one aspect, the invention provides xylanases of the invention with heterologous SPs and/or prepro sequences, e.g., sequences with a yeast signal sequence. A xylanase of the invention can comprise a heterologous SP and/or prepro in a vector, e.g., a pPIC series vector (Invitrogen, Carlsbad, Calif.).

In one aspect, SPs and/or prepro sequences of the invention are identified following identification of novel-xylanase polypeptides. The pathways by which proteins are sorted and transported to their proper cellular location are often referred to as protein targeting pathways. One of the most important elements in all of these targeting systems is a short amino acid sequence at the amino terminus of a newly synthesized polypeptide called the signal sequence. This signal sequence directs a protein to its appropriate location in the cell and is removed during transport or when the protein reaches its final destination. Most lysosomal, membrane, or secreted proteins have an amino-terminal signal sequence that marks them for translocation into the lumen of the endoplasmic reticulum. More than 100 signal sequences for proteins in this group have been determined. The signal sequences can vary in length from 13 to 36 amino acid residues. Various methods of recognition of signal sequences are known to those of skill in the art. For example, in one aspect, novel xylanase signal peptides are identified by a method referred to as SignalP. SignalP uses a combined neural network which recognizes both signal peptides and their cleavage sites. (Nielsen, et al., "Identification of prokaryotic and eukaryotic signal peptides and prediction of their cleavage sites." Protein Engineering, vol. 10, no. 1, p. 1-6 (1997).

It should be understood that in some aspects xylanases of the invention may not have SPs and/or prepro sequences, or "domains." In one aspect, the invention provides the xylanases of the invention lacking all or part of an SP and/or a prepro domain. In one aspect, the invention provides a nucleic acid sequence encoding a signal sequence (SP) and/or prepro from one xylanase operably linked to a nucleic acid sequence of a different xylanase or, optionally, a signal sequence (SPs) and/or prepro domain from a non-xylanase protein may be desired.

The invention also provides isolated or recombinant polypeptides comprising signal sequences (SPs), prepro domain and/or catalytic domains (CDs) of the invention and heterologous sequences. The heterologous sequences are sequences not naturally associated (e.g., to a xylanase) with an SP, prepro domain and/or CD. The sequence to which the SP, prepro domain and/or CD are not naturally associated can be on the SP's, prepro domain and/or CD's amino terminal end, carboxy terminal end, and/or on both ends of the SP and/or CD. In one aspect, the invention provides an isolated or recombinant polypeptide comprising (or consisting of) a polypeptide comprising a signal sequence (SP), prepro domain and/or catalytic domain (CD) of the invention with the proviso that it is not associated with any sequence to which it is naturally associated (e.g., a xylanase sequence). Similarly in one aspect, the invention provides isolated or recombinant nucleic acids encoding these polypeptides. Thus, in one aspect, the isolated or recombinant nucleic acid of the invention comprises coding sequence for a signal sequence (SP), prepro domain and/or catalytic domain (CD) of the invention and a heterologous sequence (i.e., a sequence not naturally associated with the a signal sequence (SP), prepro domain and/or catalytic domain (CD) of the invention). The heterologous sequence can be on the 3' terminal end, 5' terminal end, and/or on both ends of the SP, prepro domain and/or CD coding sequence.

Hybrid (Chimeric) Xylanases and Peptide Libraries

In one aspect, the invention provides hybrid xylanases and fusion proteins, including peptide libraries, comprising sequences of the invention. The peptide libraries of the invention can be used to isolate peptide modulators (e.g., activators or inhibitors) of targets, such as xylanase substrates, receptors, enzymes. The peptide libraries of the invention can be used to identify formal binding partners of targets, such as ligands, e.g., cytokines, hormones and the like. In one aspect, the invention provides chimeric proteins comprising a signal sequence (SP), prepro domain and/or catalytic domain (CD) of the invention or a combination thereof and a heterologous sequence (see above).

In one aspect, the fusion proteins of the invention (e.g., the peptide moiety) are conformationally stabilized (relative to linear peptides) to allow a higher binding affinity for targets. The invention provides fusions of xylanases of the invention and other peptides, including known and random peptides. They can be fused in such a manner that the structure of the xylanases is not significantly perturbed and the peptide is metabolically or structurally conformationally stabilized. This allows the creation of a peptide library that is easily monitored both for its presence within cells and its quantity.

Amino acid sequence variants of the invention can be characterized by a predetermined nature of the variation, a feature that sets them apart from a naturally occurring form, e.g., an allelic or interspecies variation of a xylanase sequence. In one aspect, the variants of the invention exhibit the same qualitative biological activity as the naturally occurring analogue. Alternatively, the variants can be selected for having modified characteristics. In one aspect, while the site or region for introducing an amino acid sequence variation is predetermined, the mutation per se need not be predetermined. For example, in order to optimize the performance of a mutation at a given site, random mutagenesis may be conducted at the target codon or region and the expressed xylanase variants screened for the optimal combination of desired activity. Techniques for making substitution mutations at predetermined sites in DNA having a known sequence are well known, as discussed herein for example, M13 primer mutagenesis and PCR mutagenesis. Screening of the mutants can be done using, e.g., assays of xylan hydrolysis. In alternative aspects, amino acid substitutions can be single residues; insertions can be on the order of from about 1 to 20 amino acids, although considerably larger insertions can be done. Deletions can range from about 1 to about 20, 30, 40, 50, 60, 70 residues or more. To obtain a final derivative with the optimal properties, substitutions, deletions, insertions or any combination thereof may be used. Generally, these changes are done on a few amino acids to minimize the alteration of the molecule. However, larger changes may be tolerated in certain circumstances.

The invention provides xylanases where the structure of the polypeptide backbone, the secondary or the tertiary structure, e.g., an alpha-helical or beta-sheet structure, has been modified. In one aspect, the charge or hydrophobicity has been modified. In one aspect, the bulk of a side chain has been modified. Substantial changes in function or immunological identity are made by selecting substitutions that are less conservative. For example, substitutions can be made which more significantly affect: the structure of the polypeptide backbone in the area of the alteration, for example a alpha-helical or a beta-sheet structure; a charge or a hydrophobic site of the molecule, which can be at an active site; or a side chain. The invention provides substitutions in polypeptide of the invention where (a) a hydrophilic residues, e.g. seryl or threonyl, is substituted for (or by) a hydrophobic residue, e.g. leucyl, isoleucyl, phenylalanyl, valyl or alanyl; (b) a cysteine or proline is substituted for (or by) any other residue; (c) a residue having an electropositive side chain, e.g. lysyl, arginyl, or histidyl, is substituted for (or by) an electronegative residue, e.g. glutamyl or aspartyl; or (d) a residue having a bulky side chain, e.g. phenylalanine, is substituted for (or by) one not having a side chain, e.g. glycine. The variants can exhibit the same qualitative biological activity (i.e. xylanase activity) although variants can be selected to modify the characteristics of the xylanases as needed.

In one aspect, xylanases of the invention comprise epitopes or purification tags, signal sequences or other fusion sequences, etc. In one aspect, the xylanases of the invention can be fused to a random peptide to form a fusion polypeptide. By "fused" or "operably linked" herein is meant that the random peptide and the xylanase are linked together, in such a manner as to minimize the disruption to the stability of the xylanase structure, e.g., it retains xylanase activity. The fusion polypeptide (or fusion polynucleotide encoding the fusion polypeptide) can comprise further components as well, including multiple peptides at multiple loops.

In one aspect, the peptides and nucleic acids encoding them are randomized, either fully randomized or they are biased in their randomization, e.g. in nucleotide/residue frequency generally or per position. "Randomized" means that each nucleic acid and peptide consists of essentially random nucleotides and amino acids, respectively. In one aspect, the nucleic acids which give rise to the peptides can be chemically synthesized, and thus may incorporate any nucleotide at any position. Thus, when the nucleic acids are expressed to form peptides, any amino acid residue may be incorporated at any position. The synthetic process can be designed to generate randomized nucleic acids, to allow the formation of all or most of the possible combinations over the length of the nucleic acid, thus forming a library of randomized nucleic acids. The library can provide a sufficiently structurally diverse population of randomized expression products to affect a probabilistically sufficient range of cellular responses to provide one or more cells exhibiting a desired response. Thus, the invention provides an interaction library large enough so that at least one of its members will have a structure that gives it affinity for some molecule, protein, or other factor.

Xylanases are multidomain enzymes that consist optionally of a signal peptide, a carbohydrate binding module, a xylanase catalytic domain, a linker and/or another catalytic domain.

The invention provides a means for generating chimeric polypeptides which may encode biologically active hybrid polypeptides (e.g., hybrid xylanases). In one aspect, the original polynucleotides encode biologically active polypeptides. The method of the invention produces new hybrid polypeptides by utilizing cellular processes which integrate the sequence of the original polynucleotides such that the resulting hybrid polynucleotide encodes a polypeptide demonstrating activities derived from the original biologically active polypeptides. For example, the original polynucleotides may encode a particular enzyme from different microorganisms. An enzyme encoded by a first polynucleotide from one organism or variant may, for example, function effectively under a particular environmental condition, e.g. high salinity. An enzyme encoded by a second polynucleotide from a different organism or variant may function effectively under a different environmental condition, such as extremely high temperatures. A hybrid polynucleotide containing sequences from the first and second original polynucleotides may encode an enzyme which exhibits characteristics of both enzymes encoded by the original polynucleotides. Thus, the enzyme encoded by the hybrid polynucleotide may function effectively under environmental conditions shared by each of the enzymes encoded by the first and second polynucleotides, e.g., high salinity and extreme temperatures.

Enzymes encoded by the polynucleotides of the invention include, but are not limited to, hydrolases, such as xylanases. Glycosidase hydrolases were first classified into families in 1991, see, e.g., Henrissat (1991) Biochem. J. 280:309-316. Since then, the classifications have been continually updated, see, e.g., Henrissat (1993) Biochem. J. 293:781-788; Henrissat (1996) Biochem. J. 316:695-696; Henrissat (2000) Plant Physiology 124:1515-1519. There are 87 identified families of glycosidase hydrolases. In one aspect, the xylanases of the invention may be categorized in families 8, 10, 11, 26 and 30. In one aspect, the invention also provides xylanase-encoding nucleic acids with a common novelty in that they are derived from a common family, e.g., family 5, 6, 8, 10, 11, 26 or 30, as set forth in Table 5, below.

TABLE 5

| SEQ ID | FAMILY |
| --- | --- |
| 9, 10 | 8 |
| 1, 2 | 8 |
| 5, 6 | 8 |
| 7, 8 | 8 |
| 99, 100 | 10 |
| 11, 12 | 10 |
| 127, 128 | 10 |
| 27, 28 | 10 |
| 97, 98 | 10 |
| 45, 46 | 10 |
| 141, 142 | 10 |
| 107, 108 | 10 |
| 129, 130 | 10 |
| 93, 94 | 10 |
| 63, 64 | 10 |
| 25, 26 | 10 |
| 49, 50 | 10 |
| 67, 68 | 10 |
| 85, 86 | 10 |
| 29, 30 | 10 |
| 51, 52 | 10 |
| 35, 36 | 10 |
| 147, 148 | 10 |

TABLE 5-continued

| SEQ ID | FAMILY |
|---|---|
| 119, 120 | 10 |
| 123, 124 | 10 |
| 249, 250 | 10 |
| 149, 150 | 10 |
| 83, 84 | 10 |
| 43, 44 | 10 |
| 133, 134 | 10 |
| 113, 114 | 10 |
| 105, 106 | 10 |
| 75, 76 | 10 |
| 111, 112 | 10 |
| 117, 118 | 10 |
| 115, 116 | 10 |
| 125, 126 | 10 |
| 137, 138 | 10 |
| 135, 136 | 10 |
| 69, 70 | 10 |
| 89, 90 | 10 |
| 31, 32 | 10 |
| 13, 14 | 10 |
| 65, 66 | 10 |
| 57, 58 | 10 |
| 77, 78 | 10 |
| 73, 74 | 10 |
| 109, 110 | 10 |
| 59, 60 | 10 |
| 71, 72 | 10 |
| 139, 140 | 10 |
| 55, 56 | 10 |
| 15, 16 | 10 |
| 131, 132 | 10 |
| 95, 96 | 10 |
| 101, 102 | 10 |
| 39, 40 | 10 |
| 143, 144 | 10 |
| 103, 104 | 10 |
| 17, 18 | 10 |
| 53, 54 | 10 |
| 21, 22 | 10 |
| 151, 152 | 10 |
| 23, 24 | 10 |
| 121, 122 | 10 |
| 41, 42 | 10 |
| 47, 48 | 10 |
| 247, 248 | 10 |
| 33, 34 | 10 |
| 19, 20 | 10 |
| 87, 88 | 10 |
| 81, 82 | 10 |
| 91, 92 | 10 |
| 61, 62 | 10 |
| 37, 38 | 10 |
| 79, 80 | 10 |
| 231, 232 | 11 |
| 157, 158 | 11 |
| 189, 190 | 11 |
| 167, 168 | 11 |
| 207, 208 | 11 |
| 251, 252 | 11 |
| 213, 214 | 11 |
| 177, 178 | 11 |
| 187, 188 | 11 |
| 205, 206 | 11 |
| 211, 212 | 11 |
| 197, 198 | 11 |
| 209, 210 | 11 |
| 185, 186 | 11 |
| 229, 230 | 11 |
| 223, 224 | 11 |
| 179, 180 | 11 |
| 193, 194 | 11 |
| 173, 174 | 11 |
| 217, 218 | 11 |
| 153, 154 | 11 |
| 219, 220 | 11 |
| 183, 184 | 11 |
| 253, 254 | 11 |
| 199, 200 | 11 |
| 255, 256 | 11 |
| 155, 156 | 11 |
| 169, 170 | 11 |
| 195, 196 | 11 |
| 215, 216 | 11 |
| 191, 192 | 11 |
| 175, 176 | 11 |
| 161, 162 | 11 |
| 221, 222 | 11 |
| 225, 226 | 11 |
| 163, 164 | 11 |
| 159, 160 | 11 |
| 233, 234 | 11 |
| 171, 172 | 11 |
| 203, 204 | 11 |
| 181, 182 | 11 |
| 227, 228 | 11 |
| 165, 166 | 11 |
| 257, 258 | 26 |
| 237, 238 | 30 |
| 241, 242 | 30 |
| 239, 240 | 30 |
| 245, 246 | 30 |
| 235, 236 | 30 |
| 313, 314 | 30 |
| 345, 346 | 10 |
| 321, 322 | 10 |
| 323, 324 | 10 |
| 315, 316 | 10 |
| 201, 202 | 10 |
| 265, 266 | 10 |
| 145, 146 | 10 |
| 287, 288 | 10 |
| 293, 294 | 10 |
| 351, 352 | 10 |
| 311, 312 | 10 |
| 279, 280 | 10 |
| 289, 290 | 10 |
| 283, 284 | 10 |
| 373, 374 | 10 |
| 337, 338 | 10 |
| 371, 372 | 10 |
| 291, 292 | 10 |
| 3, 4 | 10 |
| 307, 308 | 10 |
| 343, 344 | 10 |
| 349, 350 | 10 |
| 329, 330 | 10 |
| 355, 356 | 10 |
| 339, 340 | 10 |
| 295, 296 | 10 |
| 333, 334 | 10 |
| 281, 282 | 10 |
| 361, 362 | 10 |
| 347, 348 | 10 |
| 319, 320 | 10 |
| 357, 358 | 10 |
| 365, 366 | 10 |
| 273, 274 | 10 |
| 277, 278 | 10 |
| 271, 272 | 10 |
| 285, 286 | 10 |
| 259, 260 | 10 |
| 325, 326 | 10 |
| 331, 332 | 10 |
| 359, 360 | 10 |
| 303, 304 | 10 |
| 363, 364 | 10 |
| 305, 306 | 10 |
| 341, 342 | 10 |
| 375, 376 | 11 |
| 377, 378 | 11 |
| 379, 380 | 11 |
| 301, 302 | 11 |
| 309, 310 | 11 |
| 263, 264 | 11 |

TABLE 5-continued

| SEQ ID | FAMILY |
| --- | --- |
| 269, 270 | 11 |
| 353, 354 | 11 |
| 299, 300 | 11 |
| 367, 368 | 11 |
| 261, 262 | 11 |
| 369, 370 | 11 |
| 267, 268 | 11 |
| 317, 318 | 11 |
| 297, 298 | 11 |
| 327, 328 | 5 |
| 275, 276 | 6 |

A hybrid polypeptide resulting from the method of the invention may exhibit specialized enzyme activity not displayed in the original enzymes. For example, following recombination and/or reductive reassortment of polynucleotides encoding hydrolase activities, the resulting hybrid polypeptide encoded by a hybrid polynucleotide can be screened for specialized hydrolase activities obtained from each of the original enzymes, i.e. the type of bond on which the hydrolase acts and the temperature at which the hydrolase functions. Thus, for example, the hydrolase may be screened to ascertain those chemical functionalities which distinguish the hybrid hydrolase from the original hydrolases, such as: (a) amide (peptide bonds), i.e., xylanases; (b) ester bonds, i.e., esterases and lipases; (c) acetals, i.e., glycosidases and, for example, the temperature, pH or salt concentration at which the hybrid polypeptide functions.

Sources of the original polynucleotides may be isolated from individual organisms ("isolates"), collections of organisms that have been grown in defined media ("enrichment cultures"), or, uncultivated organisms ("environmental samples"). The use of a culture-independent approach to derive polynucleotides encoding novel bioactivities from environmental samples is most preferable since it allows one to access untapped resources of biodiversity.

"Environmental libraries" are generated from environmental samples and represent the collective genomes of naturally occurring organisms archived in cloning vectors that can be propagated in suitable prokaryotic hosts. Because the cloned DNA is initially extracted directly from environmental samples, the libraries are not limited to the small fraction of prokaryotes that can be grown in pure culture. Additionally, a normalization of the environmental DNA present in these samples could allow more equal representation of the DNA from all of the species present in the original sample. This can dramatically increase the efficiency of finding interesting genes from minor constituents of the sample which may be under-represented by several orders of magnitude compared to the dominant species.

For example, gene libraries generated from one or more uncultivated microorganisms are screened for an activity of interest. Potential pathways encoding bioactive molecules of interest are first captured in prokaryotic cells in the form of gene expression libraries. Polynucleotides encoding activities of interest are isolated from such libraries and introduced into a host cell. The host cell is grown under conditions which promote recombination and/or reductive reassortment creating potentially active biomolecules with novel or enhanced activities.

Additionally, subcloning may be performed to further isolate sequences of interest. In subcloning, a portion of DNA is amplified, digested, generally by restriction enzymes, to cut out the desired sequence, the desired sequence is ligated into a recipient vector and is amplified. At each step in subcloning, the portion is examined for the activity of interest, in order to ensure that DNA that encodes the structural protein has not been excluded. The insert may be purified at any step of the subcloning, for example, by gel electrophoresis prior to ligation into a vector or where cells containing the recipient vector and cells not containing the recipient vector are placed on selective media containing, for example, an antibiotic, which will kill the cells not containing the recipient vector. Specific methods of subcloning cDNA inserts into vectors are well-known in the art (Sambrook et al., *Molecular Cloning: A Laboratory Manual, 2nd Ed.*, Cold Spring Harbor Laboratory Press (1989)). In another aspect, the enzymes of the invention are subclones. Such subclones may differ from the parent clone by, for example, length, a mutation, a tag or a label.

In one aspect, the signal sequences of the invention are identified following identification of novel xylanase polypeptides. The pathways by which proteins are sorted and transported to their proper cellular location are often referred to as protein targeting pathways. One of the most important elements in all of these targeting systems is a short amino acid sequence at the amino terminus of a newly synthesized polypeptide called the signal sequence. This signal sequence directs a protein to its appropriate location in the cell and is removed during transport or when the protein reaches its final destination. Most lysosomal, membrane, or secreted proteins have an amino-terminal signal sequence that marks them for translocation into the lumen of the endoplasmic reticulum. More than 100 signal sequences for proteins in this group have been determined. The sequences vary in length from 13 to 36 amino acid residues. Various methods of recognition of signal sequences are known to those of skill in the art. In one aspect, the peptides are identified by a method referred to as SignalP. SignalP uses a combined neural network which recognizes both signal peptides and their cleavage sites. See, e.g., Nielsen (1997) "Identification of prokaryotic and eukaryotic signal peptides and prediction of their cleavage sites." Protein Engineering, vol. 10, no. 1, p. 1-6. It should be understood that some of the xylanases of the invention may or may not contain signal sequences. It may be desirable to include a nucleic acid sequence encoding a signal sequence from one xylanase operably linked to a nucleic acid sequence of a different xylanase or, optionally, a signal sequence from a non-xylanase protein may be desired.

The microorganisms from which the polynucleotide may be prepared include prokaryotic microorganisms, such as Eubacteria and Archaebacteria and lower eukaryotic microorganisms such as fungi, some algae and protozoa. Polynucleotides may be isolated from environmental samples in which case the nucleic acid may be recovered without culturing of an organism or recovered from one or more cultured organisms. In one aspect, such microorganisms may be extremophiles, such as hyperthermophiles, psychrophiles, psychrotrophs, halophiles, barophiles and acidophiles. Polynucleotides encoding enzymes isolated from extremophilic microorganisms can be used. Such enzymes may function at temperatures above 100° C. in terrestrial hot springs and deep sea thermal vents, at temperatures below 0° C. in arctic waters, in the saturated salt environment of the Dead Sea, at pH values around 0 in coal deposits and geothermal sulfur-rich springs, or at pH values greater than 11 in sewage sludge. For example, several esterases and lipases cloned and expressed from extremophilic organisms show high activity throughout a wide range of temperatures and pHs.

Polynucleotides selected and isolated as hereinabove described are introduced into a suitable host cell. A suitable host cell is any cell which is capable of promoting recombination and/or reductive reassortment. The selected polynucleotides are preferably already in a vector which includes appropriate control sequences. The host cell can be a higher eukaryotic cell, such as a mammalian cell, or a lower eukaryotic cell, such as a yeast cell, or preferably, the host cell can be a prokaryotic cell, such as a bacterial cell. Introduction of the construct into the host cell can be effected by calcium phosphate transfection, DEAE-Dextran mediated transfection, or electroporation (Davis et al., 1986).

As representative examples of appropriate hosts, there may be mentioned: bacterial cells, such as E. coli, Streptomyces, Salmonella typhimurium; fungal cells, such as yeast; insect cells such as Drosophila S2 and Spodoptera Sf9; animal cells such as CHO, COS or Bowes melanoma; adenoviruses; and plant cells. The selection of an appropriate host is deemed to be within the scope of those skilled in the art from the teachings herein.

With particular references to various mammalian cell culture systems that can be employed to express recombinant protein, examples of mammalian expression systems include the COS-7 lines of monkey kidney fibroblasts, described in "SV40-transformed simian cells support the replication of early SV40 mutants" (Gluzman, 1981) and other cell lines capable of expressing a compatible vector, for example, the C127, 3T3, CHO, HeLa and BHK cell lines. Mammalian expression vectors will comprise an origin of replication, a suitable promoter and enhancer and also any necessary ribosome binding sites, polyadenylation site, splice donor and acceptor sites, transcriptional termination sequences and 5' flanking nontranscribed sequences. DNA sequences derived from the SV40 splice and polyadenylation sites may be used to provide the required nontranscribed genetic elements.

In another aspect, it is envisioned the method of the present invention can be used to generate novel polynucleotides encoding biochemical pathways from one or more operons or gene clusters or portions thereof. For example, bacteria and many eukaryotes have a coordinated mechanism for regulating genes whose products are involved in related processes. The genes are clustered, in structures referred to as "gene clusters," on a single chromosome and are transcribed together under the control of a single regulatory sequence, including a single promoter which initiates transcription of the entire cluster. Thus, a gene cluster is a group of adjacent genes that are either identical or related, usually as to their function. An example of a biochemical pathway encoded by gene clusters are polyketides.

Gene cluster DNA can be isolated from different organisms and ligated into vectors, particularly vectors containing expression regulatory sequences which can control and regulate the production of a detectable protein or protein-related array activity from the ligated gene clusters. Use of vectors which have an exceptionally large capacity for exogenous DNA introduction are particularly appropriate for use with such gene clusters and are described by way of example herein to include the f-factor (or fertility factor) of E. coli. This f-factor of E. coli is a plasmid which affects high-frequency transfer of itself during conjugation and is ideal to achieve and stably propagate large DNA fragments, such as gene clusters from mixed microbial samples. One aspect of the invention is to use cloning vectors, referred to as "fosmids" or bacterial artificial chromosome (BAC) vectors. These are derived from E. coli f-factor which is able to stably integrate large segments of genomic DNA. When integrated with DNA from a mixed uncultured environmental sample, this makes it possible to achieve large genomic fragments in the form of a stable "environmental DNA library." Another type of vector for use in the present invention is a cosmid vector. Cosmid vectors were originally designed to clone and propagate large segments of genomic DNA. Cloning into cosmid vectors is described in detail in Sambrook et al., *Molecular Cloning: A Laboratory Manual, 2nd Ed.*, Cold Spring Harbor Laboratory Press (1989). Once ligated into an appropriate vector, two or more vectors containing different polyketide synthase gene clusters can be introduced into a suitable host cell. Regions of partial sequence homology shared by the gene clusters will promote processes which result in sequence reorganization resulting in a hybrid gene cluster. The novel hybrid gene cluster can then be screened for enhanced activities not found in the original gene clusters.

Therefore, in a one aspect, the invention relates to a method for producing a biologically active hybrid polypeptide and screening such a polypeptide for enhanced activity by:

1) introducing at least a first polynucleotide in operable linkage and a second polynucleotide in operable linkage, the at least first polynucleotide and second polynucleotide sharing at least one region of partial sequence homology, into a suitable host cell;
2) growing the host cell under conditions which promote sequence reorganization resulting in a hybrid polynucleotide in operable linkage;
3) expressing a hybrid polypeptide encoded by the hybrid polynucleotide;
4) screening the hybrid polypeptide under conditions which promote identification of enhanced biological activity; and
5) isolating the a polynucleotide encoding the hybrid polypeptide.

Methods for screening for various enzyme activities are known to those of skill in the art and are discussed throughout the present specification. Such methods may be employed when isolating the polypeptides and polynucleotides of the invention.

Screening Methodologies and "On-Line" Monitoring Devices

In practicing the methods of the invention, a variety of apparatus and methodologies can be used to in conjunction with the polypeptides and nucleic acids of the invention, e.g., to screen polypeptides for xylanase activity (e.g., assays such as hydrolysis of casein in zymograms, the release of fluorescence from gelatin, or the release of p-nitroanalide from various small peptide substrates), to screen compounds as potential modulators, e.g., activators or inhibitors, of a xylanase activity, for antibodies that bind to a polypeptide of the invention, for nucleic acids that hybridize to a nucleic acid of the invention, to screen for cells expressing a polypeptide of the invention and the like. In addition to the array formats described in detail below for screening samples, alternative formats can also be used to practice the methods of the invention. Such formats include, for example, mass spectrometers, chromatographs, e.g., high-throughput HPLC and other forms of liquid chromatography, and smaller formats, such as 1536-well plates, 384-well plates and so on. High throughput screening apparatus can be adapted and used to practice the methods of the invention, see, e.g., U.S. Patent Application No. 20020001809.

Capillary Arrays

Nucleic acids or polypeptides of the invention can be immobilized to or applied to an array. Arrays can be used to screen for or monitor libraries of compositions (e.g., small molecules, antibodies, nucleic acids, etc.) for their ability to bind to or modulate the activity of a nucleic acid or a polypeptide of the invention. Capillary arrays, such as the GIGAMATRIX™, Diversa Corporation, San Diego, Calif.; and arrays described in, e.g., U.S. Patent Application No. 20020080350 A1; WO 0231203 A; WO 0244336 A, provide an alternative apparatus for holding and screening samples. In one aspect, the capillary array includes a plurality of capillaries formed into an array of adjacent capillaries, wherein each capillary comprises at least one wall defining a lumen for retaining a sample. The lumen may be cylindrical, square, hexagonal or any other geometric shape so long as the walls form a lumen for retention of a liquid or sample. The capillaries of the capillary array can be held together in close proximity to form a planar structure. The capillaries can be bound together, by being fused (e.g., where the capillaries are made of glass), glued, bonded, or clamped side-by-side. Additionally, the capillary array can include interstitial material disposed between adjacent capillaries in the array, thereby forming a solid planar device containing a plurality of through-holes.

A capillary array can be formed of any number of individual capillaries, for example, a range from 100 to 4,000,000 capillaries. Further, a capillary array having about 100,000 or more individual capillaries can be formed into the standard size and shape of a Microtiter® plate for fitment into standard laboratory equipment. The lumens are filled manually or automatically using either capillary action or microinjection using a thin needle. Samples of interest may subsequently be removed from individual capillaries for further analysis or characterization. For example, a thin, needle-like probe is positioned in fluid communication with a selected capillary to either add or withdraw material from the lumen.

In a single-pot screening assay, the assay components are mixed yielding a solution of interest, prior to insertion into the capillary array. The lumen is filled by capillary action when at least a portion of the array is immersed into a solution of interest. Chemical or biological reactions and/or activity in each capillary are monitored for detectable events. A detectable event is often referred to as a "hit", which can usually be distinguished from "non-hit" producing capillaries by optical detection. Thus, capillary arrays allow for massively parallel detection of "hits".

In a multi-pot screening assay, a polypeptide or nucleic acid, e.g., a ligand, can be introduced into a first component, which is introduced into at least a portion of a capillary of a capillary array. An air bubble can then be introduced into the capillary behind the first component. A second component can then be introduced into the capillary, wherein the second component is separated from the first component by the air bubble. The first and second components can then be mixed by applying hydrostatic pressure to both sides of the capillary array to collapse the bubble. The capillary array is then monitored for a detectable event resulting from reaction or non-reaction of the two components.

In a binding screening assay, a sample of interest can be introduced as a first liquid labeled with a detectable particle into a capillary of a capillary array, wherein the lumen of the capillary is coated with a binding material for binding the detectable particle to the lumen. The first liquid may then be removed from the capillary tube, wherein the bound detectable particle is maintained within the capillary, and a second liquid may be introduced into the capillary tube. The capillary is then monitored for a detectable event resulting from reaction or non-reaction of the particle with the second liquid.

Arrays, or "Biochips"

Nucleic acids or polypeptides of the invention can be immobilized to or applied to an array. Arrays can be used to screen for or monitor libraries of compositions (e.g., small molecules, antibodies, nucleic acids, etc.) for their ability to bind to or modulate the activity of a nucleic acid or a polypeptide of the invention. For example, in one aspect of the invention, a monitored parameter is transcript expression of a xylanase gene. One or more, or, all the transcripts of a cell can be measured by hybridization of a sample comprising transcripts of the cell, or, nucleic acids representative of or complementary to transcripts of a cell, by hybridization to immobilized nucleic acids on an array, or "biochip." By using an "array" of nucleic acids on a microchip, some or all of the transcripts of a cell can be simultaneously quantified. Alternatively, arrays comprising genomic nucleic acid can also be used to determine the genotype of a newly engineered strain made by the methods of the invention. Polypeptide arrays" can also be used to simultaneously quantify a plurality of proteins. The present invention can be practiced with any known "array," also referred to as a "microarray" or "nucleic acid array" or "polypeptide array" or "antibody array" or "biochip," or variation thereof. Arrays are generically a plurality of "spots" or "target elements," each target element comprising a defined amount of one or more biological molecules, e.g., oligonucleotides, immobilized onto a defined area of a substrate surface for specific binding to a sample molecule, e.g., mRNA transcripts.

In practicing the methods of the invention, any known array and/or method of making and using arrays can be incorporated in whole or in part, or variations thereof, as described, for example, in U.S. Pat. Nos. 6,277,628; 6,277,489; 6,261, 776; 6,258,606; 6,054,270; 6,048,695; 6,045,996; 6,022,963; 6,013,440; 5,965,452; 5,959,098; 5,856,174; 5,830,645; 5,770,456; 5,632,957; 5,556,752; 5,143,854; 5,807,522; 5,800,992; 5,744,305; 5,700,637; 5,556,752; 5,434,049; see also, e.g., WO 99/51773; WO 99/09217; WO 97/46313; WO 96/17958; see also, e.g., Johnston (1998) Curr. Biol. 8:R171-R174; Schummer (1997) Biotechniques 23:1087-1092; Kern (1997) Biotechniques 23:120-124; Solinas-Toldo (1997) Genes, Chromosomes & Cancer 20:399-407; Bowtell (1999) Nature Genetics Supp. 21:25-32. See also published U.S. patent applications Nos. 20010018642; 20010019827; 20010016322; 20010014449; 20010014448; 20010012537; 20010008765.

Antibodies and Antibody-Based Screening Methods

The invention provides isolated or recombinant antibodies that specifically bind to a xylanase of the invention. These antibodies can be used to isolate, identify or quantify the xylanases of the invention or related polypeptides. These antibodies can be used to isolate other polypeptides within the scope the invention or other related xylanases. The antibodies can be designed to bind to an active site of a xylanase. Thus, the invention provides methods of inhibiting xylanases using the antibodies of the invention (see discussion above regarding applications for anti-xylanase compositions of the invention).

The invention provides fragments of the enzymes of the invention, including immunogenic fragments of a polypeptide of the invention. The invention provides compositions comprising a polypeptide or peptide of the invention and adjuvants or carriers and the like.

The antibodies can be used in immunoprecipitation, staining, immunoaffinity columns, and the like. If desired, nucleic acid sequences encoding for specific antigens can be generated by immunization followed by isolation of polypeptide or nucleic acid, amplification or cloning and immobilization of polypeptide onto an array of the invention. Alternatively, the methods of the invention can be used to modify the structure of an antibody produced by a cell to be modified, e.g., an antibody's affinity can be increased or decreased. Furthermore, the ability to make or modify antibodies can be a phenotype engineered into a cell by the methods of the invention.

Methods of immunization, producing and isolating antibodies (polyclonal and monoclonal) are known to those of skill in the art and described in the scientific and patent literature, see, e.g., Coligan, CURRENT PROTOCOLS IMMUNOLOGY, Wiley/Greene, NY (1991); Stites (eds.) BASIC AND CLINICAL IMMUNOLOGY (7th ed.) Lange Medical Publications, Los Altos, Calif. ("Stites"); Goding, MONOCLONAL ANTIBODIES: PRINCIPLES AND PRACTICE (2d ed.) Academic Press, New York, N.Y. (1986); Kohler (1975) Nature 256:495; Harlow (1988) ANTIBODIES, A LABORATORY MANUAL, Cold Spring Harbor Publications, New York. Antibodies also can be generated in vitro, e.g., using recombinant antibody binding site expressing phage display libraries, in addition to the traditional in vivo methods using animals. See, e.g., Hoogenboom (1997) Trends Biotechnol. 15:62-70; Katz (1997) Annu. Rev. Biophys. Biomol. Struct. 26:27-45.

The polypeptides of Group B amino acid sequences and sequences substantially identical thereto or fragments comprising at least 5, 10, 15, 20, 25, 30, 35, 40, 50, 75, 100, or 150 consecutive amino acids thereof, may also be used to generate antibodies which bind specifically to the polypeptides or fragments. The resulting antibodies may be used in immunoaffinity chromatography procedures to isolate or purify the polypeptide or to determine whether the polypeptide is present in a biological sample. In such procedures, a protein preparation, such as an extract, or a biological sample is contacted with an antibody capable of specifically binding to one of the polypeptides of Group B amino acid sequences and sequences substantially identical thereto, or fragments comprising at least 5, 10, 15, 20, 25, 30, 35, 40, 50, 75, 100, or 150 consecutive amino acids thereof.

In immunoaffinity procedures, the antibody is attached to a solid support, such as a bead or other column matrix. The protein preparation is placed in contact with the antibody under conditions in which the antibody specifically binds to one of the polypeptides of Group B amino acid sequences and sequences substantially identical thereto, or fragment thereof. After a wash to remove non-specifically bound proteins, the specifically bound polypeptides are eluted.

The ability of proteins in a biological sample to bind to the antibody may be determined using any of a variety of procedures familiar to those skilled in the art. For example, binding may be determined by labeling the antibody with a detectable label such as a fluorescent agent, an enzymatic label, or a radioisotope. Alternatively, binding of the antibody to the sample may be detected using a secondary antibody having such a detectable label thereon. Particular assays include ELISA assays, sandwich assays, radioimmunoassays and Western Blots.

Polyclonal antibodies generated against the polypeptides of Group B amino acid sequences and sequences substantially identical thereto, or fragments comprising at least 5, 10, 15, 20, 25, 30, 35, 40, 50, 75, 100, or 150 consecutive amino acids thereof can be obtained by direct injection of the polypeptides into an animal or by administering the polypeptides to an animal, for example, a nonhuman. The antibody so obtained will then bind the polypeptide itself. In this manner, even a sequence encoding only a fragment of the polypeptide can be used to generate antibodies which may bind to the whole native polypeptide. Such antibodies can then be used to isolate the polypeptide from cells expressing that polypeptide.

For preparation of monoclonal antibodies, any technique which provides antibodies produced by continuous cell line cultures can be used. Examples include the hybridoma technique (Kohler and Milstein, Nature, 256:495-497, 1975), the trioma technique, the human B-cell hybridoma technique (Kozbor et al., Immunology Today 4:72, 1983) and the EBV-hybridoma technique (Cole, et al., 1985, in Monoclonal Antibodies and Cancer Therapy, Alan R. Liss, Inc., pp. 77-96).

Techniques described for the production of single chain antibodies (U.S. Pat. No. 4,946,778) can be adapted to produce single chain antibodies to the polypeptides of Group B amino acid sequences and sequences substantially identical thereto, or fragments comprising at least 5, 10, 15, 20, 25, 30, 35, 40, 50, 75, 100, or 150 consecutive amino acids thereof. Alternatively, transgenic mice may be used to express humanized antibodies to these polypeptides or fragments thereof. Antibodies generated against the polypeptides of Group B amino acid sequences and sequences substantially identical thereto, or fragments comprising at least 5, 10, 15, 20, 25, 30, 35, 40, 50, 75, 100, or 150 consecutive amino acids thereof may be used in screening for similar polypeptides from other organisms and samples. In such techniques, polypeptides from the organism are contacted with the antibody and those polypeptides which specifically bind the antibody are detected. Any of the procedures described above may be used to detect antibody binding. One such screening assay is described in "Methods for Measuring Cellulase Activities", *Methods in Enzymology*, Vol 160, pp. 87-116.

Kits

The invention provides kits comprising the compositions, e.g., nucleic acids, expression cassettes, vectors, cells, transgenic seeds or plants or plant parts, polypeptides (e.g., xylanases) and/or antibodies of the invention. The kits also can contain instructional material teaching the methodologies and industrial uses of the invention, as described herein.

Whole Cell Engineering and Measuring Metabolic Parameters

The methods of the invention provide whole cell evolution, or whole cell engineering, of a cell to develop a new cell strain having a new phenotype, e.g., a new or modified xylanase activity, by modifying the genetic composition of the cell. The genetic composition can be modified by addition to the cell of a nucleic acid of the invention, e.g., a coding sequence for an enzyme of the invention. See, e.g., WO0229032; WO0196551.

To detect the new phenotype, at least one metabolic parameter of a modified cell is monitored in the cell in a "real time" or "on-line" time frame. In one aspect, a plurality of cells, such as a cell culture, is monitored in "real time" or "on-line." In one aspect, a plurality of metabolic parameters is monitored in "real time" or "on-line." Metabolic parameters can be monitored using the xylanases of the invention.

Metabolic flux analysis (MFA) is based on a known biochemistry framework. A linearly independent metabolic matrix is constructed based on the law of mass conservation and on the pseudo-steady state hypothesis (PSSH) on the intracellular metabolites. In practicing the methods of the invention, metabolic networks are established, including the:

identity of all pathway substrates, products and intermediary metabolites identity of all the chemical reactions interconverting the pathway metabolites, the stoichiometry of the pathway reactions, identity of all the enzymes catalyzing the reactions, the enzyme reaction kinetics, the regulatory interactions between pathway components, e.g. allosteric interactions, enzyme-enzyme interactions etc, intracellular compartmentalization of enzymes or any other supramolecular organization of the enzymes, and, the presence of any concentration gradients of metabolites, enzymes or effector molecules or diffusion barriers to their movement.

Once the metabolic network for a given strain is built, mathematic presentation by matrix notion can be introduced to estimate the intracellular metabolic fluxes if the on-line metabolome data is available. Metabolic phenotype relies on the changes of the whole metabolic network within a cell. Metabolic phenotype relies on the change of pathway utilization with respect to environmental conditions, genetic regulation, developmental state and the genotype, etc. In one aspect of the methods of the invention, after the on-line MFA calculation, the dynamic behavior of the cells, their phenotype and other properties are analyzed by investigating the pathway utilization. For example, if the glucose supply is increased and the oxygen decreased during the yeast fermentation, the utilization of respiratory pathways will be reduced and/or stopped, and the utilization of the fermentative pathways will dominate. Control of physiological state of cell cultures will become possible after the pathway analysis. The methods of the invention can help determine how to manipulate the fermentation by determining how to change the substrate supply, temperature, use of inducers, etc. to control the physiological state of cells to move along desirable direction. In practicing the methods of the invention, the MFA results can also be compared with transcriptome and proteome data to design experiments and protocols for metabolic engineering or gene shuffling, etc.

In practicing the methods of the invention, any modified or new phenotype can be conferred and detected, including new or improved characteristics in the cell. Any aspect of metabolism or growth can be monitored.

Monitoring Expression of an mRNA Transcript

In one aspect of the invention, the engineered phenotype comprises increasing or decreasing the expression of an mRNA transcript (e.g., a xylanase message) or generating new (e.g., xylanase) transcripts in a cell. This increased or decreased expression can be traced by testing for the presence of a xylanase of the invention or by xylanase activity assays. mRNA transcripts, or messages, also can be detected and quantified by any method known in the art, including, e.g., Northern blots, quantitative amplification reactions, hybridization to arrays, and the like. Quantitative amplification reactions include, e.g., quantitative PCR, including, e.g., quantitative reverse transcription polymerase chain reaction, or RT-PCR; quantitative real time RT-PCR, or "real-time kinetic RT-PCR" (see, e.g., Kreuzer (2001) Br. J. Haematol. 114: 313-318; Xia (2001) Transplantation 72:907-914).

In one aspect of the invention, the engineered phenotype is generated by knocking out expression of a homologous gene. The gene's coding sequence or one or more transcriptional control elements can be knocked out, e.g., promoters or enhancers. Thus, the expression of a transcript can be completely ablated or only decreased.

In one aspect of the invention, the engineered phenotype comprises increasing the expression of a homologous gene. This can be effected by knocking out of a negative control element, including a transcriptional regulatory element acting in cis- or trans-, or, mutagenizing a positive control element. One or more, or, all the transcripts of a cell can be measured by hybridization of a sample comprising transcripts of the cell, or, nucleic acids representative of or complementary to transcripts of a cell, by hybridization to immobilized nucleic acids on an array.

Monitoring Expression of a Polypeptides, Peptides and Amino Acids

In one aspect of the invention, the engineered phenotype comprises increasing or decreasing the expression of a polypeptide (e.g., a xylanase) or generating new polypeptides in a cell. This increased or decreased expression can be traced by determining the amount of xylanase present or by xylanase activity assays. Polypeptides, peptides and amino acids also can be detected and quantified by any method known in the art, including, e.g., nuclear magnetic resonance (NMR), spectrophotometry, radiography (protein radiolabeling), electrophoresis, capillary electrophoresis, high performance liquid chromatography (HPLC), thin layer chromatography (TLC), hyperdiffusion chromatography, various immunological methods, e.g. immunoprecipitation, immunodiffusion, immuno-electrophoresis, radioimmunoassays (RIAs), enzyme-linked immunosorbent assays (ELISAs), immunofluorescent assays, gel electrophoresis (e.g., SDS-PAGE), staining with antibodies, fluorescent activated cell sorter (FACS), pyrolysis mass spectrometry, Fourier-Transform Infrared Spectrometry, Raman spectrometry, GC-MS, and LC-Electrospray and cap-LC-tandem-electrospray mass spectrometries, and the like. Novel bioactivities can also be screened using methods, or variations thereof, described in U.S. Pat. No. 6,057,103. Furthermore, as discussed below in detail, one or more, or, all the polypeptides of a cell can be measured using a protein array.

Industrial Applications

The xylanase enzymes of the invention can be highly selective catalysts. They can catalyze reactions with exquisite stereo-, regio- and chemo-selectivities that are unparalleled in conventional synthetic chemistry. Moreover, enzymes are remarkably versatile. The xylanase enzymes of the invention can be tailored to function in organic solvents, operate at extreme pHs (for example, high pHs and low pHs) extreme temperatures (for example, high temperatures and low temperatures), extreme salinity levels (for example, high salinity and low salinity) and catalyze reactions with compounds that are structurally unrelated to their natural, physiological substrates.

Detergent Compositions

The invention provides detergent compositions comprising one or more polypeptides (e.g., xylanases) of the invention, and methods of making and using these compositions. The invention incorporates all methods of making and using detergent compositions, see, e.g., U.S. Pat. Nos. 6,413,928; 6,399,561; 6,365,561; 6,380,147. The detergent compositions can be a one and two part aqueous composition, a non-aqueous liquid composition, a cast solid, a granular form, a particulate form, a compressed tablet, a gel and/or a paste and a slurry form. The xylanases of the invention can also be used as a detergent additive product in a solid or a liquid form. Such additive products are intended to supplement or boost the performance of conventional detergent compositions and can be added at any stage of the cleaning process.

The actual active enzyme content depends upon the method of manufacture of a detergent composition and is not critical, assuming the detergent solution has the desired enzymatic activity. In one aspect, the amount of xylanase present in the final solution ranges from about 0.001 mg to 0.5 mg per gram of the detergent composition. The particular enzyme chosen for use in the process and products of this invention depends upon the conditions of final utility, including the physical product form, use pH, use temperature, and soil types to be degraded or altered. The enzyme can be chosen to provide optimum activity and stability for any given set of utility conditions. In one aspect, the xylanases of the present invention are active in the pH ranges of from about 4 to about 12 and in the temperature range of from about 20° C. to about 95° C. The detergents of the invention can comprise cationic, semi-polar nonionic or zwitterionic surfactants; or, mixtures thereof.

Xylanases of the invention can be formulated into powdered and liquid detergents having pH between 4.0 and 12.0 at levels of about 0.01 to about 5% (preferably 0.1% to 0.5%) by weight. These detergent compositions can also include other enzymes such as xylanases, cellulases, lipases or endoglycosidases, endo-beta.-1,4-glucanases, beta-glucanases, endo-beta-1,3(4)-glucanases, cutinases, peroxidases, laccases, amylases, glucoamylases, pectinases, reductases, oxidases, phenoloxidases, ligninases, pullulanases, arabinanases, hemicellulases, mannanases, xyloglucanases, xylanases, pectin acetyl esterases, rhamnogalacturonan acetyl esterases, polygalacturonases, rhamnogalacturonases, galactanases, pectin lyases, pectin methylesterases, cellobiohydrolases and/or transglutaminases. These detergent compositions can also include builders and stabilizers.

The addition of xylanases of the invention to conventional cleaning compositions does not create any special use limitation. In other words, any temperature and pH suitable for the detergent is also suitable for the compositions of the invention as long as the enzyme is active at or tolerant of the pH and/or temperature of the intended use. In addition, the xylanases of the invention can be used in a cleaning composition without detergents, again either alone or in combination with builders and stabilizers.

The present invention provides cleaning compositions including detergent compositions for cleaning hard surfaces, detergent compositions for cleaning fabrics, dishwashing compositions, oral cleaning compositions, denture cleaning compositions, and contact lens cleaning solutions.

In one aspect, the invention provides a method for washing an object comprising contacting the object with a polypeptide of the invention under conditions sufficient for washing. A xylanase of the invention may be included as a detergent additive. The detergent composition of the invention may, for example, be formulated as a hand or machine laundry detergent composition comprising a polypeptide of the invention. A laundry additive suitable for pre-treatment of stained fabrics can comprise a polypeptide of the invention. A fabric softener composition can comprise a xylanase of the invention. Alternatively, a xylanase of the invention can be formulated as a detergent composition for use in general household hard surface cleaning operations. In alternative aspects, detergent additives and detergent compositions of the invention may comprise one or more other enzymes such as a xylanase, a lipase, a cutinase, another xylanase, a carbohydrase, a cellulase, a pectinase, a mannanase, an arabinase, a galactanase, a xylanase, an oxidase, e.g., a lactase, and/or a peroxidase (see also, above). The properties of the enzyme(s) of the invention are chosen to be compatible with the selected detergent (i.e. pH-optimum, compatibility with other enzymatic and non-enzymatic ingredients, etc.) and the enzyme(s) is present in effective amounts. In one aspect, xylanase enzymes of the invention are used to remove malodorous materials from fabrics. Various detergent compositions and methods for making them that can be used in practicing the invention are described in, e.g., U.S. Pat. Nos. 6,333,301; 6,329,333; 6,326,341; 6,297,038; 6,309,871; 6,204,232; 6,197,070; 5,856,164.

When formulated as compositions suitable for use in a laundry machine washing method, the xylanases of the invention can comprise both a surfactant and a builder compound. They can additionally comprise one or more detergent components, e.g., organic polymeric compounds, bleaching agents, additional enzymes, suds suppressors, dispersants, lime-soap dispersants, soil suspension and anti-redeposition agents and corrosion inhibitors. Laundry compositions of the invention can also contain softening agents, as additional detergent components. Such compositions containing carbohydrase can provide fabric cleaning, stain removal, whiteness maintenance, softening, color appearance, dye transfer inhibition and sanitization when formulated as laundry detergent compositions.

The density of the laundry detergent compositions of the invention can range from about 200 to 1500 g/liter, or, about 400 to 1200 g/liter, or, about 500 to 950 g/liter, or, 600 to 800 g/liter, of composition; this can be measured at about 20° C.

The "compact" form of laundry detergent compositions of the invention is best reflected by density and, in terms of composition, by the amount of inorganic filler salt. Inorganic filler salts are conventional ingredients of detergent compositions in powder form. In conventional detergent compositions, the filler salts are present in substantial amounts, typically 17% to 35% by weight of the total composition. In one aspect of the compact compositions, the filler salt is present in amounts not exceeding 15% of the total composition, or, not exceeding 10%, or, not exceeding 5% by weight of the composition. The inorganic filler salts can be selected from the alkali and alkaline-earth-metal salts of sulphates and chlorides, e.g., sodium sulphate.

Liquid detergent compositions of the invention can also be in a "concentrated form." In one aspect, the liquid detergent compositions can contain a lower amount of water, compared to conventional liquid detergents. In alternative aspects, the water content of the concentrated liquid detergent is less than 40%, or, less than 30%, or, less than 20% by weight of the detergent composition. Detergent compounds of the invention can comprise formulations as described in WO 97/01629.

Xylanases of the invention can be useful in formulating various cleaning compositions. A number of known compounds are suitable surfactants including nonionic, anionic, cationic, or zwitterionic detergents, can be used, e.g., as disclosed in U.S. Pat. Nos. 4,404,128; 4,261,868; 5,204,015. In addition, xylanases can be used, for example, in bar or liquid soap applications, dish care formulations, contact lens cleaning solutions or products, peptide hydrolysis, waste treatment, textile applications, as fusion-cleavage enzymes in protein production, and the like. Xylanases may provide enhanced performance in a detergent composition as compared to another detergent xylanase, that is, the enzyme group may increase cleaning of certain enzyme sensitive stains such as grass or blood, as determined by usual evaluation after a standard wash cycle. Xylanases can be formulated into known powdered and liquid detergents having pH between 6.5 and 12.0 at levels of about 0.01 to about 5% (for example, about 0.1% to 0.5%) by weight. These detergent cleaning compositions can also include other enzymes such as known xylanases, xylanases, amylases, cellulases, lipases or endoglycosidases, as well as builders and stabilizers.

In one aspect, the invention provides detergent compositions having xylanase activity (a xylanase of the invention) for use with fruit, vegetables and/or mud and clay compounds (see, for example, U.S. Pat. No. 5,786,316).

Treating Fibers and Textiles

The invention provides methods of treating fibers and fabrics using one or more xylanases of the invention. The xylanases can be used in any fiber- or fabric-treating method, which are well known in the art, see, e.g., U.S. Pat. Nos. 6,261,828; 6,077,316; 6,024,766; 6,021,536; 6,017,751; 5,980,581; U.S. Patent Publication No. 20020142438 A1. For example, xylanases of the invention can be used in fiber and/or fabric desizing. In one aspect, the feel and appearance of a fabric is improved by a method comprising contacting the fabric with a xylanase of the invention in a solution. In one aspect, the fabric is treated with the solution under pressure. For example, xylanases of the invention can be used in the removal of stains.

The xylanases of the invention can be used to treat any cellulosic material, including fibers (e.g., fibers from cotton, hemp, flax or linen), sewn and unsewn fabrics, e.g., knits, wovens, denims, yarns, and toweling, made from cotton, cotton blends or natural or manmade cellulosics (e.g. originating from xylan-containing cellulose fibers such as from wood pulp) or blends thereof. Examples of blends are blends of cotton or rayon/viscose with one or more companion material such as wool, synthetic fibers (e.g. polyamide fibers, acrylic fibers, polyester fibers, polyvinyl alcohol fibers, polyvinyl chloride fibers, polyvinylidene chloride fibers, polyurethane fibers, polyurea fibers, aramid fibers), and cellulose-containing fibers (e.g. rayon/viscose, ramie, hemp, flax/linen, jute, cellulose acetate fibers, lyocell).

The textile treating processes of the invention (using xylanases of the invention) can be used in conjunction with other textile treatments, e.g., scouring and bleaching. Scouring is the removal of non-cellulosic material from the cotton fiber, e.g., the cuticle (mainly consisting of waxes) and primary cell wall (mainly consisting of pectin, protein and xyloglucan). A proper wax removal is necessary for obtaining a high wettability. This is needed for dyeing. Removal of the primary cell walls by the processes of the invention improves wax removal and ensures a more even dyeing. Treating textiles with the processes of the invention can improve whiteness in the bleaching process. The main chemical used in scouring is sodium, hydroxide in high concentrations and at high temperatures. Bleaching comprises oxidizing the textile. Bleaching typically involves use of hydrogen peroxide as the oxidizing agent in order to obtain either a fully bleached (white) fabric or to ensure a clean shade of the dye.

The invention also provides alkaline xylanases (xylanases active under alkaline conditions). These have wide-ranging applications in textile processing, degumming of plant fibers (e.g., plant bast fibers), treatment of pectic wastewaters, paper-making, and coffee and tea fermentations. See, e.g., Hoondal (2002) Applied Microbiology and Biotechnology 59:409-418.

Treating Foods and Food Processing

The xylanases of the invention have numerous applications in food processing industry. For example, in one aspect, the xylanases of the invention are used to improve the extraction of oil from oil-rich plant material, e.g., oil-rich seeds, for example, soybean oil from soybeans, olive oil from olives, rapeseed oil from rapeseed and/or sunflower oil from sunflower seeds.

The xylanases of the invention can be used for separation of components of plant cell materials. For example, xylanases of the invention can be used in the separation of xylan-rich material (e.g., plant cells) into components. In one aspect, xylanases of the invention can be used to separate xylan-rich or oil-rich crops into valuable protein and oil and hull fractions. The separation process may be performed by use of methods known in the art.

The xylanases of the invention can be used in the preparation of fruit or vegetable juices, syrups, extracts and the like to increase yield. The xylanases of the invention can be used in the enzymatic treatment (e.g., hydrolysis of xylan-comprising plant materials) of various plant cell wall-derived materials or waste materials, e.g. from cereals, grains, wine or juice production, or agricultural residues such as vegetable hulls, bean hulls, sugar beet pulp, olive pulp, potato pulp, and the like. The xylanases of the invention can be used to modify the consistency and appearance of processed fruit or vegetables. The xylanases of the invention can be used to treat plant material to facilitate processing of plant material, including foods, facilitate purification or extraction of plant components. The xylanases of the invention can be used to improve feed value, decrease the water binding capacity, improve the degradability in waste water plants and/or improve the conversion of plant material to ensilage, and the like.

In one aspect, xylanases of the invention are used in baking applications, e.g., cookies and crackers, to hydrolyze arabinoxylans and create non-sticky doughs that are not difficult to machine and to reduce biscuit size. Use xylanases of the invention to hydrolyze arabinoxylans is used to prevent rapid rehydration of the baked product resulting in loss of crispiness and reduced shelf-life. In one aspect, xylanases of the invention are used as additives in dough processing. In one aspect, xylanases of the invention are used in dough conditioning, wherein in one aspect the xylanases possess high activity over a temperature range of about 25-35° C. and at near neutral pH (7.0-7.5). In one aspect, dough conditioning enzymes can be inactivated at the extreme temperatures of baking (>500° F.).

In one aspect, xylanases of the invention are used as additives in dough processing to perform optimally under dough pH and temperature conditions. In one aspect, an enzyme of the invention is used for dough conditioning. In one aspect, a xylanase of the invention possesses high activity over a temperature range of 25-35° C. and at near neutral pH (7.0-7.5). In one aspect, the enzyme is inactivated at the extreme temperatures of baking, for example, >500° F.

Paper or Pulp Treatment

The xylanases of the invention can be in paper or pulp treatment or paper deinking. For example, in one aspect, the invention provides a paper treatment process using a xylanase of the invention. In one aspect, the xylanase of the invention is applicable both in reduction of the need for a chemical bleaching agent, such as chlorine dioxide, and in high alkaline and high temperature environments. In one aspect, the xylanase of the invention is a thermostable alkaline endoxylanase which can effect a greater than 25% reduction in the chlorine dioxide requirement of kraft pulp with a less than 0.5% pulp yield loss. In one aspect, boundary parameters are pH 10, 65-85° C. and treatment time of less than 60 minutes at an enzyme loading of less than 0.001 wt %. A pool of xylanases may be tested for the ability to hydrolyze dye-labeled xylan at, for example, pH 10 and 60° C. The enzymes that test positive under these conditions may then be evaluated at, for example pH 10 and 70° C. Alternatively, enzymes may be tested at pH 8 and pH 10 at 70° C. In discovery of xylanases desirable in the pulp and paper industry libraries from high temperature or highly alkaline environments were targeted. Specifically, these libraries were screened for enzymes functioning at alkaline pH and a temperature of approximately 45° C. In another aspect, the xylanases of the invention are useful in the pulp and paper industry in degradation of a lignin hemicellulose linkage, in order to release the lignin.

Animal Feeds and Food or Feed Additives

The invention provides methods for treating animal feeds and foods and food or feed additives using xylanases of the invention, animals including mammals (e.g., humans), birds, fish and the like. The invention provides animal feeds, foods, and additives comprising xylanases of the invention. In one aspect, treating animal feeds, foods and additives using xylanases of the invention can help in the availability of nutrients, e.g., starch, protein, and the like, in the animal feed or additive. By breaking down difficult to digest proteins or indirectly or directly unmasking starch (or other nutrients), the xylanase makes nutrients more accessible to other endogenous or exogenous enzymes. The xylanase can also simply cause the release of readily digestible and easily absorbed nutrients and sugars.

When added to animal feed, xylanases of the invention improve the in vivo break-down of plant cell wall material partly due to a reduction of the intestinal viscosity (see, e.g., Bedford et al., Proceedings of the 1st Symposium on Enzymes in Animal Nutrition, 1993, pp. 73-77), whereby a better utilization of the plant nutrients by the animal is achieved. Thus, by using xylanases of the invention in feeds the growth rate and/or feed conversion ratio (i.e. the weight of ingested feed relative to weight gain) of the animal is improved.

The animal feed additive of the invention may be a granulated enzyme product which may readily be-mixed with feed components. Alternatively, feed additives of the invention can form a component of a pre-mix. The granulated enzyme product of the invention may be coated or uncoated. The particle size of the enzyme granulates can be compatible with that of feed and pre-mix components. This provides a safe and convenient mean of incorporating enzymes into feeds. Alternatively, the animal feed additive of the invention may be a stabilized liquid composition. This may be an aqueous or oil-based slurry. See, e.g., U.S. Pat. No. 6,245,546.

Xylanases of the present invention, in the modification of animal feed or a food, can process the food or feed either in vitro (by modifying components of the feed or food) or in vivo. Xylanases can be added to animal feed or food compositions containing high amounts of xylans, e.g. feed or food containing plant material from cereals, grains and the like. When added to the feed or food the xylanase significantly improves the in vivo break-down of xylan-containing material, e.g., plant cell walls, whereby a better utilization of the plant nutrients by the animal (e.g., human) is achieved. In one aspect, the growth rate and/or feed conversion ratio (i.e. the weight of ingested feed relative to weight gain) of the animal is improved. For example a partially or indigestible xylan-comprising protein is fully or partially degraded by a xylanase of the invention, e.g. in combination with another enzyme, e.g., beta-galactosidase, to peptides and galactose and/or galactooligomers. These enzyme digestion products are more digestible by the animal. Thus, xylanases of the invention can contribute to the available energy of the feed or food. Also, by contributing to the degradation of xylan-comprising proteins, a xylanase of the invention can improve the digestibility and uptake of carbohydrate and non-carbohydrate feed or food constituents such as protein, fat and minerals.

In another aspect, xylanase of the invention can be supplied by expressing the enzymes directly in transgenic feed crops (as, e.g., transgenic plants, seeds and the like), such as grains, cereals, corn, soy bean, rape seed, lupin and the like. As discussed above, the invention provides transgenic plants, plant parts and plant cells comprising a nucleic acid sequence encoding a polypeptide of the invention. In one aspect, the nucleic acid is expressed such that the xylanase of the invention is produced in recoverable quantities. The xylanase can be recovered from any plant or plant part. Alternatively, the plant or plant part containing the recombinant polypeptide can be used as such for improving the quality of a food or feed, e.g., improving nutritional value, palatability, and Theological properties, or to destroy an antinutritive factor.

In one aspect, the invention provides methods for removing oligosaccharides from feed prior to consumption by an animal subject using a xylanase of the invention. In this process a feed is formed having an increased metabolizable energy value. In addition to xylanases of the invention, galactosidases, cellulases and combinations thereof can be used. In one aspect, the enzyme is added in an amount equal to between about 0.1% and 1% by weight of the feed material. In one aspect, the feed is a cereal, a wheat, a grain, a soybean (e.g., a ground soybean) material. See, e.g., U.S. Pat. No. 6,399,123.

In another aspect, the invention provides methods for utilizing xylanase as a nutritional supplement in the diets of animals by preparing a nutritional supplement containing a recombinant xylanase enzyme comprising at least thirty contiguous amino acids of an amino acid of Group B amino acid sequences, and administering the nutritional supplement to an animal to increase the utilization of xylan contained in food ingested by the animal.

In yet another aspect, the invention provides an edible pelletized enzyme delivery matrix and method of use for delivery of xylanase to an animal, for example as a nutritional supplement. The enzyme delivery matrix readily releases a xylanase enzyme, such as one having an amino acid sequence of group B amino acid sequences, or at least 30 contiguous amino acids thereof, in aqueous media, such as, for example, the digestive fluid of an animal. The invention enzyme delivery matrix is prepared from a granulate edible carrier selected from such components as grain germ that is spent of oil, hay, alfalfa, timothy, soy hull, sunflower seed meal, wheat midd, and the like, that readily disperse the recombinant enzyme contained therein into aqueous media. In use, the edible pelletized enzyme delivery matrix is administered to an animal to delivery of xylanase to the animal. Suitable grain-based substrates may comprise or be derived from any suitable edible grain, such as wheat, corn, soy, sorghum, alfalfa, barley, and the like. An exemplary grain-based substrate is a corn-based substrate. The substrate may be derived from any suitable part of the grain, but is preferably a grain germ approved for animal feed use, such as corn germ that is obtained in a wet or dry milling process. The grain germ preferably comprises spent germ, which is grain germ from which oil has been expelled, such as by pressing or hexane or other solvent extraction. Alternatively, the grain germ is expeller extracted, that is, the oil has been removed by pressing.

The enzyme delivery matrix of the invention is in the form of discrete plural particles, pellets or granules. By "granules" is meant particles that are compressed or compacted, such as by a pelletizing, extrusion, or similar compacting to remove water from the matrix. Such compression or compacting of the particles also promotes intraparticle cohesion of the particles. For example, the granules can be prepared by pelletizing the grain-based substrate in a pellet mill. The pellets prepared thereby are ground or crumbled to a granule size suitable for use as an adjuvant in animal feed. Since the matrix is itself approved for use in animal feed, it can be used as a diluent for delivery of enzymes in animal feed.

Preferably, the enzyme delivery matrix is in the form of granules having a granule size ranging from about 4 to about 400 mesh (USS); more preferably, about 8 to about 80 mesh; and most preferably about 14 to about 20 mesh. If the grain germ is spent via solvent extraction, use of a lubricity agent such as corn oil may be necessary in the pelletizer, but such a lubricity agent ordinarily is not necessary if the germ is expeller extracted. In other aspects of the invention, the matrix is prepared by other compacting or compressing processes such as, for example, by extrusion of the grain-based substrate through a die and grinding of the extrudate to a suitable granule size.

The enzyme delivery matrix may further include a polysaccharide component as a cohesiveness agent to enhance the cohesiveness of the matrix granules. The cohesiveness agent is believed to provide additional hydroxyl groups, which enhance the bonding between grain proteins within the matrix granule. It is further believed that the additional hydroxyl groups so function by enhancing the hydrogen bonding of proteins to starch and to other proteins. The cohesiveness agent may be present in any amount suitable to enhance the cohesiveness of the granules of the enzyme delivery matrix. Suitable cohesiveness agents include one or more of dextrins, maltodextrins, starches, such as corn starch, flours, cellulosics, hemicellulosics, and the like. For example, the percentage of grain germ and cohesiveness agent in the matrix (not including the enzyme) is 78% corn germ meal and 20% by weight of corn starch.

Because the enzyme-releasing matrix of the invention is made from biodegradable materials, the matrix may be subject to spoilage, such as by molding. To prevent or inhibit such molding, the matrix may include a mold inhibitor, such as a propionate salt, which may be present in any amount sufficient to inhibit the molding of the enzyme-releasing matrix, thus providing a delivery matrix in a stable formulation that does not require refrigeration.

The xylanase enzyme contained in the invention enzyme delivery matrix and methods is preferably a thermostable xylanase, as described herein, so as to resist inactivation of the xylanase during manufacture where elevated temperatures and/or steam may be employed to prepare the palletized enzyme delivery matrix. During digestion of feed containing the invention enzyme delivery matrix, aqueous digestive fluids will cause release of the active enzyme. Other types of thermostable enzymes and nutritional supplements that are thermostable can also be incorporated in the delivery matrix for release under any type of aqueous conditions.

A coating can be applied to the invention enzyme matrix particles for many different purposes, such as to add a flavor or nutrition supplement to animal feed, to delay release of animal feed supplements and enzymes in gastric conditions, and the like. Or, the coating may be applied to achieve a functional goal, for example, whenever it is desirable to slow release of the enzyme from the matrix particles or to control the conditions under which the enzyme will be released. The composition of the coating material can be such that it is selectively broken down by an agent to which it is susceptible (such as heat, acid or base, enzymes or other chemicals). Alternatively, two or more coatings susceptible to different such breakdown agents may be consecutively applied to the matrix particles.

The invention is also directed towards a process for preparing an enzyme-releasing matrix. In accordance with the invention, the process comprises providing discrete plural particles of a grain-based substrate in a particle size suitable for use as an enzyme-releasing matrix, wherein the particles comprise a xylanase enzyme encoded by an amino acid sequence of Group B amino acid sequences or at least 30 consecutive amino acids thereof. Preferably, the process includes compacting or compressing the particles of enzyme-releasing matrix into granules, which most preferably is accomplished by pelletizing. The mold inhibitor and cohesiveness agent, when used, can be added at any suitable time, and preferably are mixed with the grain-based substrate in the desired proportions prior to pelletizing of the grain-based substrate. Moisture content in the pellet mill feed preferably is in the ranges set forth above with respect to the moisture content in the finished product, and preferably is about 14-15%. Preferably, moisture is added to the feedstock in the form of an aqueous preparation of the enzyme to bring the feedstock to this moisture content. The temperature in the pellet mill preferably is brought to about 82° C. with steam. The pellet mill may be operated under any conditions that impart sufficient work to the feedstock to provide pellets. The pelleting process itself is a cost-effective process for removing water from the enzyme-containing composition.

In one aspect, the pellet mill is operated with a ⅛ in. by 2 in. die at 100 lb./min. pressure at 82° C. to provide pellets, which then are crumbled in a pellet mill crumbler to provide discrete plural particles having a particle size capable of passing through an 8 mesh screen but being retained on a 20 mesh screen.

The thermostable xylanases of the invention can be used in the pellets of the invention. They can have high optimum temperatures and high heat resistance such that an enzyme reaction at a temperature not hitherto carried out can be achieved. The gene encoding the xylanase according to the present invention (e.g. as set forth in any of the sequences in Group A nucleic acid sequences) can be used in preparation of xylanases (e.g. using GSSM™ as described herein) having characteristics different from those of the xylanases of Group B amino acid sequences (in terms of optimum pH, optimum temperature, heat resistance, stability to solvents, specific activity, affinity to substrate, secretion ability, translation rate, transcription control and the like). Furthermore, a polynucleotide of Group A nucleic acid sequences may be employed for screening of variant xylanases prepared by the methods described herein to determine those having a desired activity, such as improved or modified thermostability or thermotolerance. For example, U.S. Pat. No. 5,830,732, describes a screening assay for determining thermotolerance of a xylanase.

Waste Treatment

The xylanases of the invention can be used in a variety of other industrial applications, e.g., in waste treatment. For example, in one aspect, the invention provides a solid waste digestion process using xylanases of the invention. The methods can comprise reducing the mass and volume of substantially untreated solid waste. Solid waste can be treated with an enzymatic digestive process in the presence of an enzymatic solution (including xylanases of the invention) at a controlled temperature. This results in a reaction without appreciable bacterial fermentation from added microorganisms. The solid waste is converted into a liquefied waste and any residual solid waste. The resulting liquefied waste can be separated from said any residual solidified waste. See e.g., U.S. Pat. No. 5,709,796.

Oral Care Products

The invention provides oral care product comprising xylanases of the invention. Exemplary oral care products include toothpastes, dental creams, gels or tooth powders, odontics, mouth washes, pre- or post brushing rinse formulations, chewing gums, lozenges, or candy. See, e.g., U.S. Pat. No. 6,264,925.

Brewing and Fermenting

The invention provides methods of brewing (e.g., fermenting) beer comprising xylanases of the invention. In one exemplary process, starch-containing raw materials are disintegrated and processed to form a malt. A xylanase of the invention is used at any point in the fermentation process. For example, xylanases of the invention can be used in the processing of barley malt. The major raw material of beer brewing is barley malt. This can be a three stage process. First, the barley grain can be steeped to increase water content, e.g., to around about 40%. Second, the grain can be germinated by incubation at 15 to 25° C. for 3 to 6 days when enzyme synthesis is stimulated under the control of gibberellins. In one aspect, xylanases of the invention are added at this (or any other) stage of the process. Xylanases of the invention can be used in any beer or alcoholic beverage producing process, as described, e.g., in U.S. Pat. Nos. 5,762,991; 5,536,650; 5,405,624; 5,021,246; 4,788,066.

In one aspect, an enzyme of the invention is used to improve filterability and wort viscosity and to obtain a more complete hydrolysis of endosperm components. Use of an enzyme of the invention would also increase extract yield. The process of brewing involves germination of the barley grain (malting) followed by the extraction and the breakdown of the stored carbohydrates to yield simple sugars that are used by yeast for alcoholic fermentation. Efficient breakdown of the carbohydrate reserves present in the barley endosperm and brewing adjuncts requires the activity of several different enzymes.

In one aspect, an enzyme of the invention has activity in slightly acidic pH (e.g., 5.5-6.0) in, e.g., the 40° C. to 70° C. temperature range; and, in one aspect, with inactivation at 95° C. Activity under such conditions would be optimal, but are not an essential requirement for efficacy. In one aspect, an enzyme of the invention has activity between 40-75° C., and pH 5.5-6.0; stable at 70° for at least 50 minutes, and, in one aspect, is inactivated at 96-100° C. Enzymes of the invention can be used with other enzymes, e.g., beta-1,4-endoglucanases and amylases.

Medical and Research Applications

Xylanases of the invention can be used as antimicrobial agents due to their bacteriolytic properties. Xylanases of the invention can be used to eliminating or protecting animals from salmonellae, as described in e.g., PCT Application Nos. WO0049890 and WO9903497.

Other Industrial Applications

Xylanases of the invention can be used, including Group B amino acid sequences are used in a wide variety of food, animal feed and beverage applications. New xylanases are discovered by screening existing libraries and DNA libraries constructed from diverse mesophilic and moderately thermophilic locations as well as from targeted sources including digestive flora, microorganisms in animal waste, soil bacteria and highly alkaline habitats. Biotrap and primary enrichment strategies using arabinoxylan substrates and/or non-soluble polysaccharide fractions of animal feed material are also useful.

Two screening formats (activity-based and sequence-based) are used in the discovery of novel xylanases. The activity-based approach is direct screening for xylanase activity in agar plates using a substrate such as AZO-xylan (Megazyme). Alternatively a sequence-based approach may be used, which relies on bioinformatics and molecular biology to design probes for hybridization and biopanning. See, for example, U.S. Pat. Nos. 6,054,267, 6,030,779, 6,368,798, 6,344,328. Hits from the screening are purified, sequenced, characterized (for example, determination of specificity, temperature and pH optima), analyzed using bioinformatics, subcloned and expressed for basic biochemical characterization. These methods may be used in screening for xylanases useful in a myriad of applications, including dough conditioning and as animal feed additive enzymes.

In characterizing enzymes obtained from screening, the exemplary utility in dough processing and baking applications may be assessed. Characterization may include, for example, measurement of substrate specificity (xylan, arabinoxylan, CMC, BBG), temperature and pH stability and specific activity. A commercial enzyme may be used as a benchmark. In one aspect, the enzymes of the invention have significant activity at pH $\geq 7$ and 25-35° C., are inactive on insoluble xylan, are stable and active in 50-67% sucrose.

In another aspect, utility as feed additives may be assessed from characterization of candidate enzymes. Characterization may include, for example, measurement of substrate specificity (xylan, arabinoxylan, CMC, B$\beta$G), temperature and pH stability, specific activity and gastric stability. In one aspect the feed is designed for a monogastric animal and in another aspect the feed is designed for a ruminant animal. In one aspect, the enzymes of the invention have significant activity at pH 2-4 and 35-40° C., a half-life greater than 30 minutes in gastric fluid, formulation (in buffer or cells) half-life greater than 5 minutes at 85° C. and are used as a monogastric animal feed additive. In another aspect, the enzymes of the invention have one or more of the following characteristics: significant activity at pH 6.5-7.0 and 35-40° C., a half-life greater than 30 minutes in rumen fluid, formulation stability as stable as dry powder and are used as a ruminant animal feed additive.

Enzymes are reactive toward a wide range of natural and unnatural substrates, thus enabling the modification of virtually any organic lead compound. Moreover, unlike traditional chemical catalysts, enzymes are highly enantio- and regio-selective. The high degree of functional group specificity exhibited by enzymes enables one to keep track of each reaction in a synthetic sequence leading to a new active compound. Enzymes are also capable of catalyzing many diverse reactions unrelated to their physiological function in nature. For example, peroxidases catalyze the oxidation of phenols by hydrogen peroxide. Peroxidases can also catalyze hydroxylation reactions that are not related to the native function of the enzyme. Other examples are xylanases which catalyze the breakdown of polypeptides. In organic solution some xylanases can also acylate sugars, a function unrelated to the native function of these enzymes.

The present invention exploits the unique catalytic properties of enzymes. Whereas the use of biocatalysts (i.e., purified or crude enzymes, non-living or living cells) in chemical transformations normally requires the identification of a particular biocatalyst that reacts with a specific starting compound, the present invention uses selected biocatalysts and reaction conditions that are specific for functional groups that are present in many starting compounds. Each biocatalyst is specific for one functional group, or several related functional groups and can react with many starting compounds containing this functional group. The biocatalytic reactions produce a population of derivatives from a single starting compound. These derivatives can be subjected to another round of biocatalytic reactions to produce a second population of derivative compounds. Thousands of variations of the original compound can be produced with each iteration of biocatalytic derivatization.

Enzymes react at specific sites of a starting compound without affecting the rest of the molecule, a process which is very difficult to achieve using traditional chemical methods. This high degree of biocatalytic specificity provides the means to identify a single active compound within the library. The library is characterized by the series of biocatalytic reactions used to produce it, a so-called "biosynthetic history". Screening the library for biological activities and tracing the biosynthetic history identifies the specific reaction sequence producing the active compound. The reaction sequence is repeated and the structure of the synthesized compound determined. This mode of identification, unlike other synthesis and screening approaches, does not require immobilization technologies and compounds can be synthesized and tested free in solution using virtually any type of screening assay. It is important to note, that the high degree of specificity of enzyme reactions on functional groups allows for the "tracking" of specific enzymatic reactions that make up the biocatalytically produced library.

Many of the procedural steps are performed using robotic automation enabling the execution of many thousands of biocatalytic reactions and screening assays per day as well as ensuring a high level of accuracy and reproducibility. As a result, a library of derivative compounds can be produced in a matter of weeks which would take years to produce using current chemical methods. (For further teachings on modification of molecules, including small molecules, see PCT/US94/09174).

The invention will be further described with reference to the following examples; however, it is to be understood that the invention is not limited to such examples.

EXAMPLES

Example 1

Plate Based Endoglycosidase Enzyme Discovery: Expression Screening

Titer determination of Lambda Library: Add 1.0 µL of Lambda Zap Express amplified library stock to 600 µL $E.\ coli$ MRF' cells ($OD_{600}$=1.0). Dilute MRF' stock with 10 mM $MgSO_4$. Incubate mixture at 37° C. for 15 minutes, then transfer suspension to 5-6 mL of NZY top agar at 50° C. and gently mix. Immediately pour agar solution onto large (150 mm) NZY media plate and allow top agar to solidify completely (approximately 30 minutes). Invert the plate. Incubate the plate at 39° C. for 8-12 hours. (The number of plaques is approximated. Phage titer determined to give 50,000 pfu/plate. Dilute an aliquot of Library phage with SM buffer if needed.)

Substrate screening: Add Lambda Zap Express (50,000 pfu) from amplified library to 600 µL of $E.\ coli$ MRF' cells ($OD_{600}$=1.0) and incubate at 37° C. for 15 minutes. While phage/cell suspension is incubating, add 1.0 mL of desired polysaccharide dye-labeled substrate (usually 1-2% w/v) to 5.0 mL NZY top agar at 50° C. and mix thoroughly. (Solution kept at 50° C. until needed.) Transfer the cell suspension to substrate/top agar solution and gently mix. Immediately pour solution onto large (150 mm) NZY media plate. Allow top agar to solidify completely (approximately 30 minutes), then invert plate. Incubate plate at 39° C. for 8-12 hours. Observe plate for clearing zones (halos) around plaques. Core plaques with halos out of agar and transfer to a sterile micro tube. (A large bore 200 µL pipette tip works well to remove (core) the agar plug containing the desired plaque.) Resuspend phage in 500 µL SM buffer. Add 20µL chloroform to inhibit any further cell growth.

Isolation of pure clones: Add 5 µL of resuspended phage suspension to 500 µL of $E.\ coli$ MRF' cells ($OD_{600}$=10.0). Incubate at 37° C. for 15 minutes. While phage/cell suspension is incubating, add 600 µL of desired polysaccharide dye-labeled substrate (usually 1-2% w/v) to 3.0 mL NZY top agar at 50° C. and mix thoroughly. (Solution kept at 50° C. until needed.) Transfer cell suspension to substrate/top agar solution and gently mix. Immediately pour solution onto small (90 mm) NZY media plate and allow top agar to solidify completely (approximately 30 minutes), then invert plate. Incubate plate at 39° C. for 8-12 hours. Plate observed for a clearing zone (halo) around a single plaque (pure clone). (If a single plaque cannot be isolated, adjust titer and replate phage suspension.) Phage are resuspended in 500 µL SM buffer and 20 µL Chloroform is added to inhibit any further cell growth.

Excision of pure clone: Allow pure phage suspension to incubate at room temperature for 2 to 3 hours or overnight at 4° C. Add 100 µL of pure phage suspension to 200 µL $E.\ coli$ MRF' cells ($OD_{600}$=1.0). Add 1.0 µL of ExAssist helper phage (>1×10$^6$ pfu/mL; Stratagene). Incubate suspension at 37° C. for 15 minutes. Add 3.0 mL of 2×YT media to cell suspension. Incubate at 37° C. for 2-2.5 hours while shaking. Transfer tube to 70° C. for 20 minutes. Transfer 50-100 µL of phagemid suspension to a micro tube containing 200 µL of $E.\ coli$ Exp 505 cells ($OD_{600}$=1.0). Incubate suspension at 37° C. for 45 minutes. Plate 100 µL of cell suspension on $LB_{kan\ 50}$ media (LB media with Kanamycin 50 µg/mL). Incubate plate at 37° C. for 8-12 hours. Observe plate for colonies. Any colonies that grow contain the pure phagemid. Pick a colony and grow a small (3-10 mL) liquid culture for 8-12 hours. Culture media is liquid $LB_{kan\ 50}$.

Activity verification: Transfer 11.0 mL of liquid culture to a sterile micro tube. Centrifuge at 13200 rpm (16000 g's) for 1 minute. Discard supernatant and add 200 µL of phosphate buffer pH 6.2. Sonicate for 5 to 10 seconds on ice using a micro tip. Add 200 µL of appropriate substrate, mix gently and incubate at 37° C. for 1.5-2 hours. A negative control should also be run that contains only buffer and substrate. Add 1.0 mL absolute ethanol (200 proof) to suspension and mixed. Centrifuge at 13200 rpm for 10 minutes. Observe supernatant for color. Amount of coloration may vary, but any tubes with more coloration than control is considered positive for activity. A spectrophotometer can be used for this step if so desired or needed. (For Azo-xylan, Megazyme, read at 590 nm).

RFLP of pure clones from same Libraries: Transfer 11.0 mL of liquid culture to a sterile micro tube. Centrifuge at 13200 rpm (16000 g's) for 1 minute. Follow QIAprep spin mini kit (Qiagen) protocol for plasmid isolation and use 40 µL holy water as the elution buffer. Transfer 10 µL plasmid DNA to a sterile micro tube. Add 1.5 µL Buffer 3 (New England Biolabs), 1.5 µL 100×BSA solution (New England Biolabs) and 2.0 µL holy water. To this add 1.0 µL Not 1 and 1.0 µL Pst 1 restriction endonucleases (New England Biolabs). Incubate for 1.5 hours at 37° C. Add 3.0 µL 6× Loading buffer (Invitrogen). Run 15 µL of digested sample on a 1.0% agarose gel for 1-1.5 hours at 120 volts. View the gel with a gel imager. Perform sequence analysis on all clones with a different digest pattern.

Table 6 describes various properties of exemplary enzymes of the invention.

TABLE 6

| SEQ ID NO. | Topt* | Tstab** | pHopt* | Significant activities | pI | M_w | Notes |
|---|---|---|---|---|---|---|---|
| 151, 152 | 50° C. | <1 min at 65° C. | 5.5-9.0 | AZO-xylan | 5.7 | 40.2 | |
| 155, 156 | 50° C. | <1 min at 65° C. | 5.5-8.0 | AZO-xylan | 8.8 | 62.7 | |
| 169, 170 | 50° C. | >1 min at 65° C.; <1 min at 85° C. | 7.0 | AZO-xylan | 8.7 | 36.7 | |
| 195, 196 | 50° C. | >1 min at 65° C. <10 min, <1 min 85° C. | 5.5 | AZO-xylan | 8.5 | 36.7 | |
| 215, 216 | 85° C. | <3 min at 85° C. | 5.5-8.0 | AZO-xylan | 8.6 | 34.8 | |
| 47, 48 | 50° C. | <0.5 min at 65° C.; <1 min at 85° C. | 7.0-8.0 | AZO-xylan | 6.2 | 40.3 | |
| 191, 192 | ³85° C. | >30 sec at 85° C. | 5.5 | AZO-xylan | 7.8 | 34.6 | |
| 247, 248 | 50° C. | <1 min at 65° C. | 8.0 | AZO-xylan | 9.4 | 43.5 | |
| 7, 8 | 50° C. | >1 min 85° C. <5 min | 5.5 | AZO-xylan | 4.5 | 55.3 | |
| 221, 222 | 50-65° C. | <1 min at 75° C. | 5.5 | AZO-xylan | 8.3 | 34.6 | |
| 163, 164 | 65° C. | <1 min at 65° C. | 7.0 | AZO-xylan | 6.3 | 36.0 | |
| 19, 20 | 37° C. | <5 min at 50° C. | 7.0-8.0 | AZO-xylan | 9.2 | 41.5 | |
| 87, 88 | 37-50° C. | <1 min at 85° C. | 8.0 | AZO-xylan | 5.2 | 36.7 | |
| 81, 82 | 50° C. | <1 min at 65° C. | 7.0-9.0 | AZO-xylan | 5.3 | 38.8 | |
| 91, 92 | 50° C. | <1 min at 65° C. | 7-8 | AZO-xylan, AZO-CMC | 5.4 | 39.0 | |
| 61, 62 | 37° C. | <5 min at 50° C. | 7.0-9.0 | AZO-xylan, AZO-CMC | 5.4 | 40 | |
| 159, 160 | 85° C. | <30 sec at 85° C. | 5.5 | AZO-xylan | 8.3 | 34.5 | |
| 233, 234 | 50° C. | >30 sec <1 min at 65° c.; <1 min at 85° C. | 7.0 | AZO-xylan | 8.5 | 35.1 | |
| 203, 204 | 50-65° C. | >1 min at 65° C. <5 min, <1 min 85° C. | 5.5 | AZO-xylan | 9.5 | 21.7 | |
| 181, 182 | ³85° C. | >1 min at 85° C. | 5.5-8.0 | AZO-xylan | 8.8 | 35.5 | |
| 227, 228 | 65° C. | >1 min at 85° C. <5 min | 5.5-7.0 | AZO-xylan | 7.8 | 25.8 | |
| 45, 46 | ³45° C. | ³5 min 45° C., <0.5 min 55° C. | >5.5 | AZO-xylan | 6.7 | 40.4 | *** |
| 231, 232 | 65° C. | >10 min at 50° C. | 5.5-7.0 | AZO-xylan | 8.4 | 31.4 | |
| 129, 130 | 65° C. | <1 min at 75° C. | 5.5 | AZO-xylan | 5.1 | 116 | |
| 93, 94 | 50° C. | <1 min at 60° C. | 8.0-9.0 | AZO-xylan | 5.3 | 39.1 | |
| 189, 190 | 65° C. | <1 min at 65° C. | 5.5 | AZO-xylan | 9.2 | 20.3 | **** |
| 49, 50 | 70° C. | <20 min 70° C. | >5 | AZO-xylan | 5.7 | 38.9 | |
| 85, 86 | 50° C. | >5 min at 85° C. | 5.5-7.0 | AZO-xylan | 6.1 | 48.4 | |
| 99, 100 | 50° C. | <1 min at 75° C. | 5.5-8.0 | AZO-xylan | 10.8 | 36.6 | |
| 123, 124 | ³85° C. | <30 sec 100° C. | 5.5-7.0 | AZO-xylan | 6.1 | 44.1 | |
| 249, 250 | 45° C. | >1 min 75° C. <10 min | 5.5 | AZO-xylan | 5.3 | 93 | |
| 167, 168 | 85° C. | <5 min 85° C. | 5.5 | AZO-xylan | 9.5 | 21.7 | |
| 207, 208 | 75° C. | <5 min 65° C. | 5.5 | AZO-xylan | 9.1 | 20.4 | |
| 251, 252 | 65-75° C. | <1 min 85° C. | 5.5 | AZO-xylan | 8.8 | 20.4 | ***** |
| 11, 12 | <90° C. | <40 min 70° C. | >6 | AZO-xylan | 6.8 | 43.9 | |
| 177, 178 | 65° C. | <1 min at 75° C. | 5.5 | AZO-xylan | 8.7 | 44.6 | |
| 9, 10 | 50° C. | <1 min at 65° C. | 5.5-7.0 | AZO-xylan | 4.9 | 46.1 | |
| 43, 44 | 37° C. | unstable | 5.5-7.0 | AZO-xylan | 4.9 | 39.1 | |
| 113, 114 | 65-75° C. | <1 min at 75° C. | 5.5-8.0 | AZO-xylan | 5 | 41.2 | |
| 75, 76 | 50° C. | <1 min 85° C. | 7.0-9.0 | AZO-xylan | 4.7 | 39.4 | |
| 111, 112 | 37° C. | >10 min 50° C. | 7-8 | AZO-xylan | 5.6 | 41.0 | |
| 117, 118 | 37° C. | unstable | 7-8 | AZO-xylan | 9.1 | 53.3 | |
| 115, 116 | — | — | — | AZO-xylan | 8.9 | 50.8 | |
| 125, 126 | 37° C. | — | 8.0 | AZO-xylan | 5.3 | 41.1 | |
| 137, 138 | 50° C. | <30 sec at 65° C. | 5.5 | AZO-xylan | 5.7 | 38.5 | |
| 69, 70 | ³85° C. | <5 min at 85° C. | 5.5-9.0 | AZO-xylan | 6.4 | 58.0 | |
| 205, 206 | 50° C. | <1 min at 65° C. | 5.5-8 | AZO-xylan | 4.3 | 35.1 | |
| 211, 212 | 50° C. | <1 min at 65° C. | 5.5 | AZO-xylan | 4.4 | 35.4 | |
| 197, 198 | 65° C. | <1 min at 65° C. | 5.5 | AZO-xylan | 8.8 | 20.1 | |
| 31, 32 | 37° C. | unstable | 7.0 | AZO-xylan | 5.1 | 54.4 | |
| 13, 14 | 50° C. | <1 min at 65° C. | 7 | AZO-xylan | 5.5 | 40.0 | |
| 65, 66 | 50° C. | <1 min at 65° C. | 5.5 | AZO-xylan, AZO-CMC | 4.8 | 55.5 | |
| 257, 258 | 37° C. | unstable | 5.5 | AZO-xylan, AZO-barley β-glucan, AZO-CMC | 5.3 | 100.8 | |
| 57, 58 | 50° C. | <1 min at 65° C. | 7.0 | AZO-xylan | 4.8 | 56.7 | |
| 185, 186 | 50-75° C. | <1 min at 80° C. | 5.5 | AZO-xylan | 8.8 | 23.2 | |
| 243, 244 | 75° C. | >0.5 min @ 85° C. | 5.5 | AZO-xylan | 8.8 | 44.4 | |
| 77, 78 | 50° C. | <5 min at 65° C., <1 min 85° C. | 5.5 | AZO-xylan | 5.3 | 44.5 | |
| 229, 230 | 37° C. | ³30 min 55° C., <5 min 75° C. | 5.5 | AZO-xylan | 8.7 | 20.6 | ****** |
| 109, 110 | 65° C. | >0.5 min @ 75° C. | 5.5 | AZO-xylan | 4.9 | 45.2 | |
| 193, 194 | 65° C. | <1 min at 75° C. | 5.5 | AZO-xylan | 5.4 | 29.1 | |
| 173, 174 | 65° C. | <1 min at 80° C. | 7.0 | AZO-xylan | 7.6 | 51.6 | |
| 59, 60 | 37° C. | <1 min at 65° C. | 7.0 | AZO-xylan | 6.6 | 42.5 | |
| 101, 102 | 50° C. | >0.5 min @ 65° C. | 7.0 | AZO-xylan | 8.7 | 41.1 | |

TABLE 6-continued

| SEQ ID NO. | Topt* | Tstab** | pHopt* | Significant activities | pI | $M_w$ | Notes |
|---|---|---|---|---|---|---|---|
| 55, 56 | 37° C. | >5 min at 50° C.; <1 min at 85° C. | 7.0 | AZO-xylan | 6.5 | 41.8 | |
| 15, 16 | 50° C. | <1 min at 65° C. | 7.0 | AZO-xylan | 6.4 | 40.2 | |
| 131, 132 | — | — | — | AZO-xylan | 5.6 | 42.1 | |
| 145, 146 | 65-85° C. | <1 min at 85° C. | 5.5 | AZO-xylan | 5.2 | 43.7 | |
| 219, 220 | — | — | 5.5 | AZO-xylan | 6.6 | 34.5 | |
| 253, 254 | 65° C. | >.5 min at 85° C. | 5.5-7 | AZO-xylan | 7.8 | 34.6 | |
| 255, 256 | 65° C. | >1 min 65° C. <3 min | 5.5-7.0 | AZO-xylan | 8.3 | 35.0 | |

*pH or temperature optima determined by initial rates using AZO-AZO-xylan as a substrate
**thermal stability, time that enzyme retained significant activity (approx. >50%)
*** Dough conditioning
**** GSSM ™ parent for thermal tolerance evolution for animal feed applications
***** N35D mutation made to increase low pH activity-based on public knowledge-mutant enzyme's relative activity at pH 4 significantly increased
****** Dough conditioning Example 2

GSSM™ Screen for Thermal Tolerant Mutants

The following example describes an exemplary method for screening for thermally tolerant enzymes.

Master Plates: Prepare plates for a colony picker by labeling 96 well plates and aliquoting 200 µL LB Amp 100 into each well. (~20 ml needed per 96 well plate). After the plates are returned from the picker, remove media from row 6 from plate A. Replace with an inoculation of SEQ ID NO: 189. Place in a humidified 37° C. incubator overnight.

Assay Plates: Pin tool cultures into a fresh 96 well plate (200 µL/well LB Amp100). Remove plastic cover and replace with Gas Permeable Seal. Place in a humidified incubator overnight. Remove the seal and replace plastic lid. Spin cultures down in tabletop centrifuge at 3000 rpm for 10 min. Remove supernatant by inversion onto a paper towel. Aliquot 45 µL Cit-Phos-KCl buffer pH 6 into each well. Replace the plastic lid with an aluminum plate seal. Use a roller to get a good seal. Resuspend cells in a plate shaker at level 6-7 for ~30 seconds.

Place the 96 well plate in 80° C. incubator for 20 minutes. Do not stack. Thereafter, immediately remove plates to ice water to cool for a few minutes. Remove the aluminum seal and replace with a plastic lid. Add 30 µL of 2% Azo-xylan. Mix as before on the plate shaker. Incubate 37° C. in a humidified incubator overnight.

Add 200 µL ethanol to each well and pipette up and down a couple of times to mix. As an alternative to changing tips each time, rinse in an ethanol wash and dry by expelling into a paper towel. Spin the plates at 3000 rpm for 10 minutes. Remove 100 µL of supernatant to a fresh 96 well plate. Read the $OD_{590}$ Example 3

GSSM™ Assay for HIT Verification of Thermal Tolerant Mutants

The following example describes an exemplary method for assaying for thermally tolerant enzymes.

Pin tool or pick clones into duplicate 96 well plates (200 ul/well LB Amp 100). Remove the plastic cover and replace with a Gas Permeable Seal. Place in a humidified incubator overnight. Remove the Seal and replace with a plastic lid. Pintool the clones to solid agar. Spin cultures down in tabletop centrifuge at 3000 rpm for 10 min. Remove the supernatant by inversion onto a paper towel. Aliquot 25 µl BPER/Lysozyme/DNase solution (see below) into each well. Resuspend cells in a plate shaker on level 6-7 for ~30 seconds.

Incubate the plate on ice for 15 minutes. Add 20 µL of Cit-Phos-KCl buffer pH 6 into each well. Replace the plastic lid with an aluminum plate seal. Use a roller to get a good seal. Mix on a plate shaker at level 6-7 for ~30 seconds.

Place one 96 well plate in an 80° C. incubator for 20 minutes and the other at 37° C. Do not stack. Immediately remove the plates to watery ice to cool for a few minutes (use a large plastic tray if needed). Remove the aluminum seal. Add 30 µl of 2% Azo-xylan.

Seal with a plastic gas permeable seal. Mix as before on the plate shaker. Incubate a set of 37° C. and 80° C. plates in humidified incubator at 37° C. for 2 hours and another set for 4 hours.

After incubation, let the plate sit for 5 minutes at room temperature. Add 200 µL ethanol to each well and pipette up and down a couple of times to mix. Instead of changing tips each time, rinse in an ethanol wash and dry by expelling into a paper towel. But, use a new set of tips for each clone. Spin plates at 3000 rpm 10 minutes. Remove 100 µL of supernatant to a fresh 96 well plate. Read $OD_{590}$.

BPER/Lysozyme/DNase solution (4.74 mL total):
4.5 mL BPR
200 µL 10 mg/mL Lysozyme (made fresh in pH 6 Cit-phos-buffer)
40 µL 5 mg/mL DNase I (made fresh in pH 6 Cit-phos buffer Example 4

Xylanase Assay with Wheat Arabinoxylan as Substrate

The following example describes an exemplary xylanase assay that can be used, for example, to determine is an enzyme is within the scope of the invention.

SEQ ID NOS: 11, 12, 69, 70, 77, 78, 113, 114, 149, 150, 159, 160, 163, 164, 167, 168, 181, 182, 197, and 198 were subjected to an assay at pH 8 (Na-phosphate buffer) and 70° C. using wheat arabinoxylan as a substrate. The enzymes were characterized as set forth in Table 7.

TABLE 7

| SEQ ID NOS: | Protein Concentration (mg/ml) | volume of lysate added to each vial | #of vials | Units/ml* | protein (mg/mL) | U/mg |
|---|---|---|---|---|---|---|
| 11, 12 | 42 | 0.5 | 10 | 163 | 22.0 | 7.4 |
| 113, 114 | 37 | 0.6 | 10 | 66 | 22.0 | 3.0 |
| 163, 164 | 35 | 0.6 | 10 | 25 | 22.0 | 1.1 |
| 197, 198 | 23 | 1.0 | 10 | 31 | 22.0 | 1.4 |
| 167, 168 | 10 | 2.2 | 10 | 228 | 22.0 | 10.4 |
| 77, 78 | 47 | 0.5 | 10 | 29 | 22.0 | 1.3 |
| 69, 70 | 18 | 1.3 | 10 | 36 | 22.0 | 1.7 |
| 181, 182 | 28 | 0.8 | 10 | 24 | 22.0 | 1.1 |
| 159, 160 | 25 | 0.9 | 10 | 43 | 22.0 | 2.0 |
| 149, 150 | 42 | 0.5 | 10 | 24 | 22.0 | 1.1 |

*Based on addition of 1 mL of water to each sample.
Units are umoles xylose released per minute based on a reducing sugar assay.

Example 5

Generation of an Exemplary Xylanase of the Invention

The following example describes the generation of an exemplary xylanase of the invention using gene site-saturation mutagenesis (GSSM™) technology, designated the "9x" variant or mutant (the nucleic acid as set forth in SEQ ID NO:377, the polypeptide sequence as set forth in SEQ ID NO:378).

GSSM™ was used to create a comprehensive library of point mutations in the exemplary SEQ ID NO:190, "wild-type" xylanase (encoded by SEQ ID NO:189). The xylanase thermotolerance screen described above identified nine single site amino acid mutants (FIG. 6A) (D8F, Q11H, N12L, G17I, G60H, P64V, S65V, G68A & S79P) that had improved thermal tolerance relative to the wild type enzyme (as measured following a heat challenge at 80° C. for 20 minutes). Wild-type enzyme and all nine single site amino acid mutants were produced in $E.\ coli$ and purified utilizing an N-terminal hexahistidine tag. There was no noticeable difference in activity due to the tag.

Figure 6:
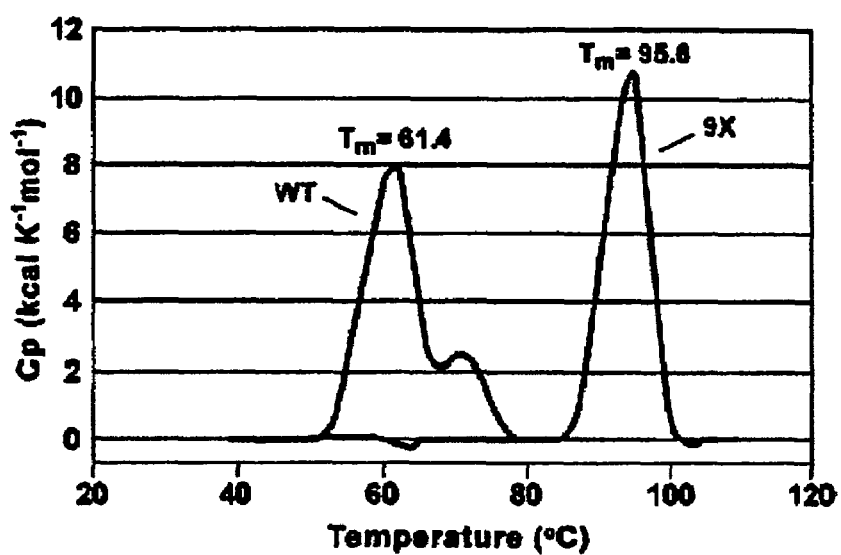
FIG. 6A illustrates the nine single site amino acid mutants of SEQ ID NO:378 (encoded by SEQ ID NO:377) as generated by Gene Site Saturation Mutagenesis (GSSM™) of SEQ ID NO:190 (encoded by SEQ ID NO:189), as described in detail in Example 5, below.
FIG. 6B illustrates the unfolding of SEQ ID NO:190 and SEQ ID NO:378 in melting temperature transition midpoint (Tm) experiments as determined by DSC for each enzyme, as described in detail in Example 5, below.

FIG. 6 illustrates the nine single site amino acid mutants of "variant 9x", or, as set forth in SEQ ID NO:378 (encoded by SEQ ID NO:377), as generated by Gene Site Saturation Mutagenesis (GSSM™) of the exemplary SEQ ID NO:190 "wild-type" enzyme (encoded by SEQ ID NO:189). FIG. 6A is a schematic diagram illustrating position, numbering and the amino acid change for the thermal tolerant point mutants of the "wild-type" gene (SEQ ID NO:190, encoded by SEQ ID NO:189). A library of all 64 codons was generated for every amino acid position in the gene (~13,000 mutants) and screened for mutations that increased thermal tolerance. The "9X" variant was generated by combining all 9 single-site mutants into one enzyme. The corresponding melting temperature transition midpoint ($T_m$) determined by DSC for each mutant enzyme and the "9X" (SEQ ID NO:378) variant is shown on the right. FIG. 6B illustrates the unfolding of the "wild-type" (SEQ ID NO:190) and "9X" (SEQ ID NO:378) "variant/mutant" enzymes was monitored by DSC at a scan rate of 1° C./min. Baseline subtracted DSC data were normalized for protein concentration.

Xylanase Activity Assays

Enzymatic activities were determined using 400 ∝L of 2% Azo-xylan as substrate in 550 ∝L of CP (citrate-phosphate) buffer, pH 6.0 at the indicated temperatures. Activity measurements as a function of pH were determined using 50 mM Britton and Robinson buffer solutions (pH 3.0, 5.0, 6.0, 7.0, 8.0 and 9.0) prepared by mixing solutions of 0.1 M phosphoric acid solution, 0.1 M boric acid and 0.1 M acetic acid followed by pH adjustment with 1 M sodium hydroxide. Reactions were initiated by adding 50 ∝L of 0.1 mg/ml of purified enzyme. Time points were taken from 0 to 15 minutes where 50 ∝L of reaction mixture was added to 200 ∝L of precipitation solution (100% ethanol). When all time points had been taken, samples were mixed, incubated for 10 minutes and centrifuged at 3000 g for 10 minutes at 4° C. Supernatant (150 ∝L) was aliquoted into a fresh 96 well plate and absorbance was measured at 590 nm. $A_{590}$ values were plotted against time and the initial rate was determined from the slope of the line.

Differential Scanning Calorimetry (DSC).

Calorimetry was performed using a Model 6100 Nano II DSC apparatus (Calorimetry Sciences Corporation, American Fork, Utah) using the DSCRun software package for data acquisition, CpCalc for analysis, CpConvert for conversion into molar heat capacity from microwatts and CpDeconvolute for deconvolution. Analysis was carried out with 1 mg/ml recombinant protein in 20 mM potassium phosphate (pH 7.0) and 100 mM KCl at a scan rate of 1° C./min. A constant pressure of 5 atm was maintained during all DSC experiments to prevent possible degassing of the solution on heating. The instrumental baseline was recorded routinely before the experiments with both cells filled with buffer. Reversibility of the thermally induced transitions was tested by reheating the solution in the calorimeter cell immediately after cooling the first run.

Thermal Tolerance Determination.

All enzymes were analyzed for thermal tolerance at 80° C. in 20 mM potassium phosphate (pH 7.0) and 100 mM KCl. The enzymes were heated at 80° C. for 0, 5, 10 or 30 minutes in thin-walled tubes and were cooled on ice. Residual activities were determined with Azo-xylan as substrate using the assay described above for activity measurement.

Polysaccharide Fingerprinting.

Polysaccharide fingerprints were determined by polysaccharide analysis using carbohydrate gel electrophoresis (PACE). Beechwood xylan (0.1 mg/mL, 100 ∝L, Sigma, Poole, Dorset, UK) or xylooligosaccharides (1 mM, 20 ∝L, Megazyme, Wicklow, Ireland) were treated with enzyme (1-3 ∝g) in a total volume of 250 ∝L for 16 hours. The reaction was buffered in 0.1 M ammonium acetate pH 5.5. Controls without substrates or enzymes were performed under the same conditions to identify any unspecific compounds in the enzymes, polysaccharides/oligosaccharides or labeling reagents. The reactions were stopped by boiling for 20 min. Assays were independently performed at least 2 times for each condition. Derivatization using ANTS (8-aminon-aphthalene-1,3,6-trisulfonic acid, Molecular Probes, Leiden, The Netherlands), electrophoresis and imaging were carried out as described (Goubet, F., Jackson, P., Deery, M. and Dupree, P. (2002) *Anal. Biochem.* 300, 53-68).

Fitness Calculation.

The fitness ($F_n$), for a given enzyme variant, n, was calculated by equally weighting increase in denaturation temperature transition midpoint ($T_m$) and increase (or decrease) in enzymatic activity relative to the largest difference in each parameter across all variants: $F_n = F_{Tn} + F_{Vn}$, where $F_{Tn} = T_m$ fitness factor of the variant and $F_{Vn}$ = activity fitness factor of the variant. The fitness factors for each ($T_m$ and activity) are relative to the largest difference in $T_m$ or rate across all of the variants. $F_{Tn}=(T_m-T_{mL})/(T_{mH}-T_{mL})$ where $T_{mn}$ is the $T_m$ for the given variant, n, and $T_{mL}$ is the lowest $T_m$ across all variants and $T_{mH}$ the highest $T_m$ across all variants and $F_{Vn}=(V_n-V_L)/(V_H-V_L)$ where $V_n$ is the relative rate for the given variant, n, and $V_L$ is the lowest rate across all variants and $V_H$ the highest rate across all variants.

Evolution by the GSSM™ Method.

GSSM™ technology was used to create a comprehensive library of point mutations in the exemplary xylanase of the invention SEQ ID NO:190 (encoded by SEQ ID NO:189); including the exemplary xylanase of the invention SEQ ID NO:378 (encoded by SEQ ID NO:377). The xylanase thermotolerance screen described above identified nine single site amino acid mutants (FIG. 6A), D8F, Q11H, N12L, G17I, G60H, P64V, S65V, G68A & S79P, that had improved thermal tolerance relative to the exemplary "Wild type" enzyme SEQ ID NO:190 (encoded by SEQ ID NO:189), as measured following a heat challenge at 80° C. for 20 minutes. Wild-type enzyme and all nine single site amino acid mutants were produced in E. coli and purified utilizing an N-terminal hexahistidine tag. There was no noticeable difference in activity due to the tag.

To determine the effect of the single amino acid mutations on enzymatic activity, all nine mutants were purified and their xylanase activity (initial rates at the wild-type temperature optimum, 70° C.) was compared to that of the exemplary SEQ ID NO:190 "wild-type" enzyme. Enzyme activities were comparable to wild type (initial rate normalized to 1.0) for D8F, N12L, G17I, G60H, P64V, S65V G68A and S79P mutants (relative initial rates 0.65, 0.68, 0.76, 1.1, 1.0, 1.2, 0.98 and 0.84 respectively) confirming that these mutations do not significantly alter the enzymatic activity. Initial rates were measured 3 or more times and variance was typically less than 10%. In contrast to these eight mutants, a notable reduction in enzymatic activity was observed for the best thermal tolerant, single site mutant, Q11H (relative initial rate 0.35).

Melting Temperature ($T_m$) of "Wild-Type" and Thermal Tolerant Single Site Amino Acid Mutant Enzymes.

The purified SEQ ID NO:190 "wild-type" xylanase and the nine thermal tolerant single site amino acid mutants were analyzed using differential scanning calorimetry (DSC). Aggregation was apparent for the wild-type enzyme as evidenced by a shoulder in the DSC trace for its thermal denaturation, see FIG. 6B. The evolved mutant enzymes showed no indication of aggregation. For all enzymes, thermally induced denaturation was irreversible and no discernible transition was observed in a second scan of the sample. Due to the irreversibility of denaturation, only the apparent $T_m$ (melting temperature) could be calculated (as described, e.g., by Sanchez-Ruiz (1992) Biophys. J. 61:921-935; Beldarrain (2000) Biotechnol. Appl. Biochem. 31:77-84). The $T_m$ of the wild-type enzyme was 61° C. while the $T_m$'s of all point mutants were increased and ranged from 64° C. to 70° C. (FIG. 6A). The Q11H mutation introduced the largest increase ($T_m$=70° C.) over wild-type followed by P64V (69° C.), G17I (67° C.) and D8F (67° C.).

The "9X" Combined GSSM™ Exemplary Enzyme SEQ ID NO:378

The "9X" enzyme (SEQ ID NO:378) was constructed by combining the single-site changes of the nine thermal tolerant up-mutants by site-directed mutagenesis (FIG. 6A). The "9X" (SEQ ID NO:378) enzyme was expressed in E. coli and purified to homogeneity. DSC was performed to determine the melting temperature. The $T_m$ of "9X" enzyme was 34 degrees higher than SEQ ID NO:190, the "wild-type" enzyme, demonstrating a dramatic shift in its thermal stability FIG. 6B).

Figure 7:
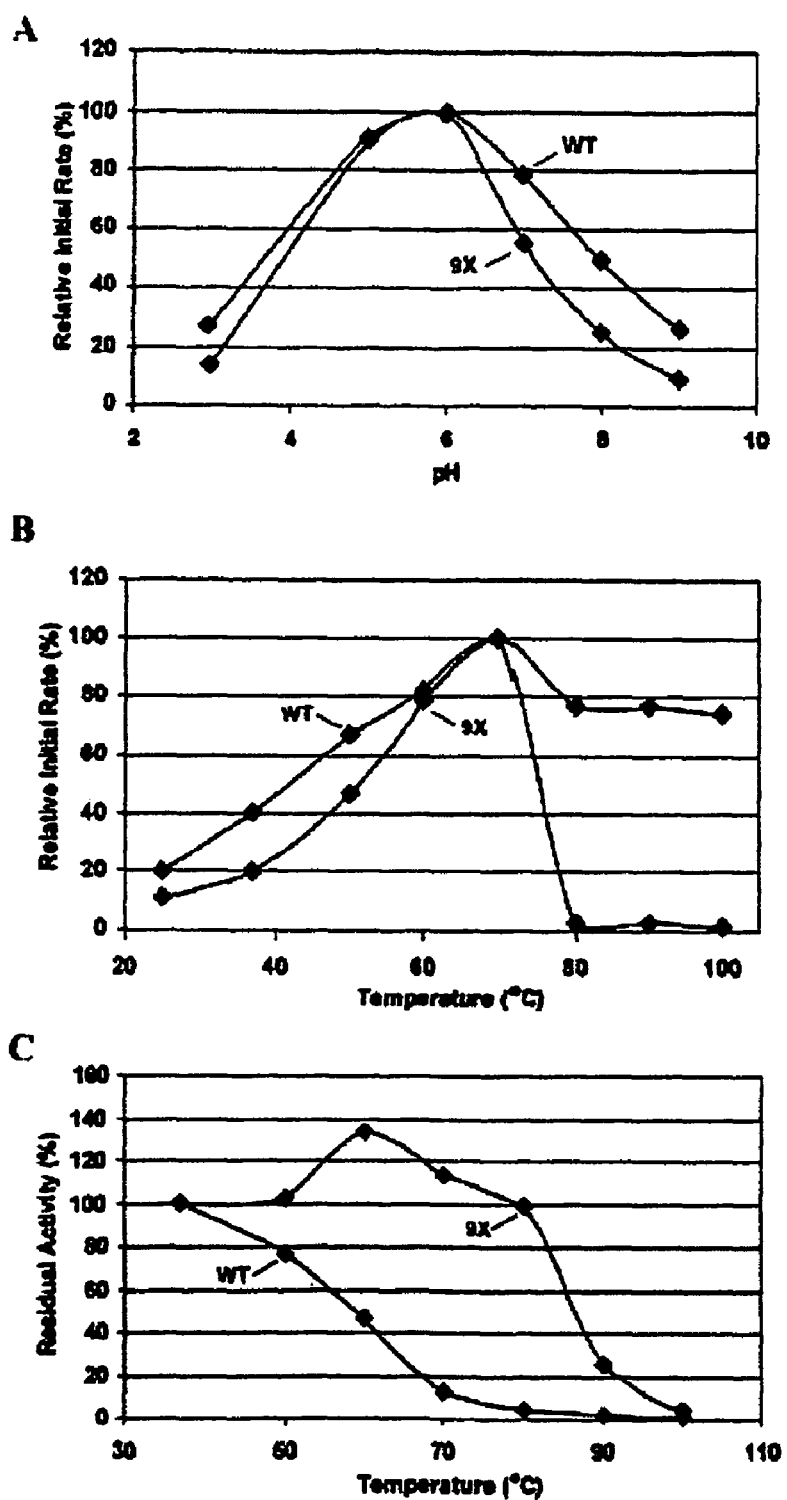
FIG. 7A illustrates the pH and temperature activity profiles for the enzymes SEQ ID NO:190 and SEQ ID NO:378, as described in detail in Example 5, below.
FIG. 7B illustrates the rate/temperature activity optima for the enzymes SEQ ID NO:190 and SEQ ID NO:378, as described in detail in Example 5, below.
FIG. 7C illustrates the thermal tolerance/residual activity for the enzymes SEQ ID NO:190 and SEQ ID NO:378, as described in detail in Example 5, below.

To evaluate the effect of the combined mutations and elevated melting temperature on the enzyme's biochemical properties, pH and temperature profiles were constructed and compared to SEQ ID NO:190, the "wild-type" enzyme. FIG. 7 illustrates the biochemical characterization of "wild type" and "evolved" 9× mutant enzymes. FIG. 7A illustrates the pH-dependence of activity for the wild-type and evolved 9× mutant enzymes. Xylanase activity was measured at 37° C. at each pH and the initial velocity was plotted against absorbance at 590 nm to determine initial rates. FIG. 7B illustrates the temperature-dependence of activity for the wild-type and evolved 9× mutant enzymes. The optimum temperatures of the wild-type and 9× mutant enzymes were measured over a temperature range of 25-100° C. at pH 6.0 and are based on initial rates measured over 5 minutes. FIG. 7C illustrates the thermal stability of wild-type and evolved 9× mutant enzymes. Thermal dependence of activity of the wild-type and evolved 9× mutant enzymes was measured by first heating the enzymes at each of the indicated temperatures for 5 minutes followed by cooling to room temperature and the measurement of residual activity (initial rate at 37° C., pH 6.0). For all experiments initial rates were measured 2 or more times and the variation was less than 10%.

SEQ ID NO:190 and SEQ ID NO:378 (the "9X" mutant) enzyme had comparable pH/activity profiles with the highest activity between pH 5 and 6 (FIG. 7A). Both enzymes had similar initial rate/temperature optima at 70° C., however, SEQ ID NO:190, the "wild-type" enzyme had higher activity at lower temperatures (25-50° C.) whereas SEQ ID NO:378 (the "9X" mutant) retained more than 60% of its activity up to 1001C (determined by initial rate) in the presence of substrate (FIG. 7B). The activity of SEQ ID NO:190, the "wild-type" enzyme was not detectable at temperatures above 70° C.

To determine the effect of the 9 combined mutations on enzyme thermal tolerance, residual activity was measured and compared to SEQ ID NO:190, the "wild-type" enzyme. Residual activity was determined by a heat challenge for 5 minutes at each temperature (37, 50, 60, 70, 80 and 90° C.) followed by activity measurements at 37° C. SEQ ID NO:190 was completely inactivated above 70° C. while the evolved 9× mutant displayed significant activity after heating at 70, 80 and even 90° C. (FIG. 7C). Furthermore, although the activity of the wild-type enzyme decreased with increasing temperature, the 9× variant was somewhat activated by heating at temperatures up to 60° C.

Generation of Combinatorial GSSM™ Variants Using GeneReassembly™ Technology.

Figure 8:
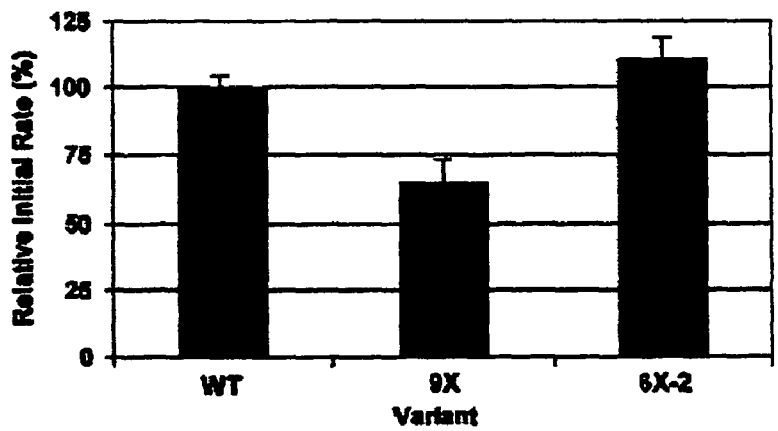
FIG. 8A illustrates the GeneReassembly™ library of all possible combinations of the 9 GSSM™ point mutations that was constructed and screened for variants with improved thermal tolerance and activity, as described in detail in Example 5, below.
FIG. 8B illustrates the relative activity of the "6X-2" variant and "9X" variant (SEQ ID NO:378) compared to SEQ ID NO:190 ("wild-type") at a temperature optimum and pH 6.0, as described in detail in Example 5, below.

To identify combinatorial variants of the 9 single site amino acid mutants with highest thermal tolerance and activity compared to the additively constructed SEQ ID NO:378 (the "9X" variant), a GeneReassembly™ library (U.S. Pat. No. 6,537,776) of all possible mutant combinations ($2^9$) was constructed and screened. Using thermal tolerance as the screening criterion, 33 unique combinations of the nine mutations were identified as was the original 9× variant. A secondary screen was performed to select for variants with higher activity/expression than the evolved 9×. This screen yielded 10 variants with sequences possessing between 6 and 8 of the original single mutations in various combinations, as illustrated in FIG. 8A. FIG. 8 illustrates the combinatorial variants identified using GeneReassembly™ technology. FIG. 8A illustrates the GeneReassembly™ library of all possible combinations of the 9 GSSM™ point mutations that was constructed and screened for variants with improved thermal tolerance and activity. Eleven variants including the 9× variant were obtained. As shown in the figure, the variants possessed 6, 7, 8, or 9 of the point mutations in various combinations. The corresponding melting temperature transition midpoint (Tm) determined by DSC of each variant is shown on the right. FIG. 8B illustrates the relative activity (initial rate measured over a 5 minute time period) of the 6X-2 and 9× variants compared to wild-type at the temperature optimum (70° C.) and pH 6.0. Error bars show the range in the initial rate for 3 measurements.

The melting temperature ($T_m$) of each of the combinatorial variants was at least 28° C. higher than wild type (FIG. 8A) and all of the reassembly variants displayed higher relative activity than the 9× enzyme. The activity of one variant in particular, 6X-2, was greater than the wild-type enzyme and significantly better (1.7X) than the 9× enzyme (FIG. 8B). Sequence comparison of the reassembly variants identified at least 6 mutations that were required for the enhanced thermostability (>20 degrees). All 33 unique variants found in the initial thermostability screen contained both Q11H and G17I mutations demonstrating their importance for thermal tolerance.

Analysis of Wild-Type and Variant Polysaccharide Product Fingerprints.

Figure 9:
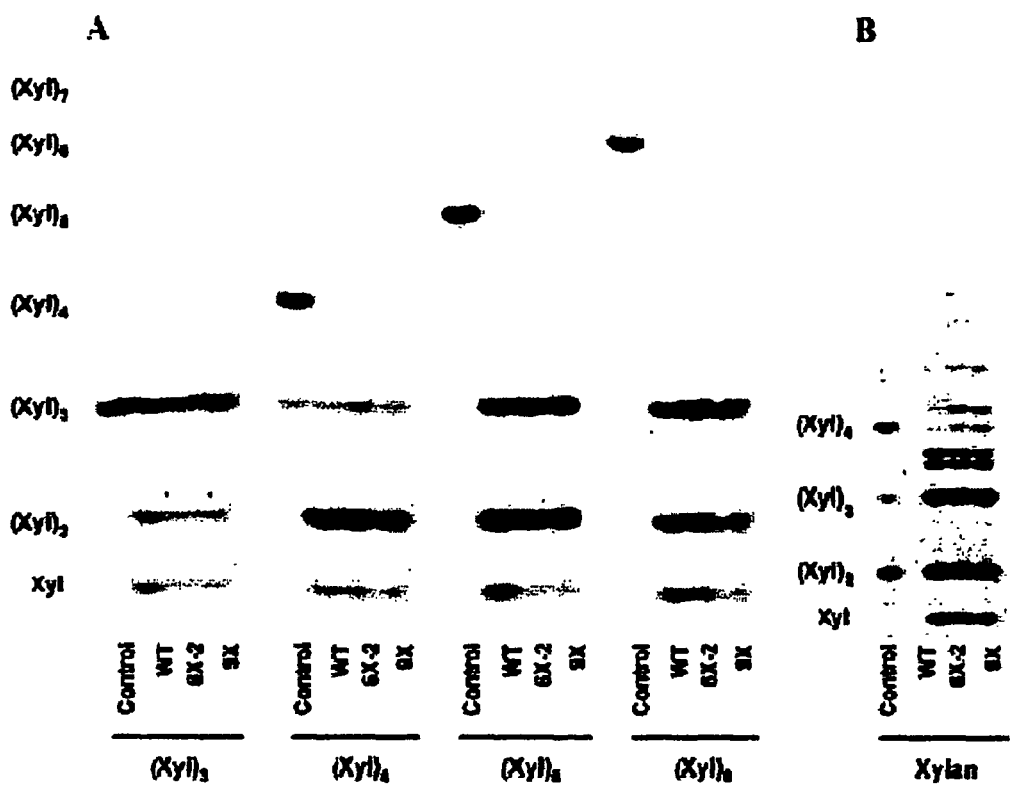
FIG. 9A illustrates the fingerprints obtained after hydrolysis of oligoxylans (Xyl)3, (Xyl)4, (Xyl)5 and (Xyl)6 by the SEQ ID NO:190 ("wild-type") and the "9X" variant (SEQ ID NO:378) enzymes, as described in detail in Example 5, below.
FIG. 9B illustrates the fingerprints obtained after hydrolysis of Beechwood xylan by the SEQ ID NO:190 ("wild-type") and the "9X" variant (SEQ ID NO:378) enzymes, as described in detail in Example 5, below.

The products generated by the "wild-type," 6X-2 and 9× variants were compared by polysaccharide analysis using carbohydrate gel electrophoresis (PACE). Different substrates (oligosaccharides and polysaccharides) were tested for hydrolysis by the xylanases. The digestion products of the 3 xylanases tested were very similar, as illustrated in FIG. 9. All three enzymes hydrolyzed $(Xyl)_6$ and $(Xyl)_5$, mainly into both $(Xyl)_3$ and $(Xyl)_2$, and $(Xyl)_4$ was hydrolyzed to $(Xyl)_2$ (FIG. 9A). Only a small amount of hydrolysis of $(Xyl)_3$ into $(Xyl)_2$ and Xyl was observed indicating that $(Xyl)_3$ is a relatively poor substrate for the enzyme. No activity was detected on $(Xyl)_2$. Beechwood xylan, which contains glucuronosyl residues, was hydrolyzed by all three enzymes mainly into $(Xyl)_2$ and $(Xyl)_3$, but other bands were detected that migrated between oligoxylan bands (FIG. 9B). In PACE analysis, each oligosaccharide has a specific migration depending on the sugar composition and degree of polymerization (Goubet, F., Jackson, P., Deery, M. and Dupree, P. (2002) *Anal. Biochem.* 300, 53-68), thus, these bands likely correspond to oligoglucuronoxylans. Therefore, the evolved enzymes retained the substrate specificity of the "wild-type" enzyme.

As noted above, FIG. 9 illustrates the product fingerprints of "wild-type" SEQ ID NO:190 (encoded by SEQ ID NO:189), 6X-2 (SEQ ID NO:380, encoded by SEQ ID NO:379) and SEQ ID NO:378 (the "9X" mutant) enzyme variant, as determined by PACE.

FIG. 9A illustrates fingerprints obtained after hydrolysis of oligoxylans $(Xyl)_3$, $(Xyl)_4$, $(Xyl)_5$ and $(Xyl)_6$ by "wild-type" and variant enzymes. Control lanes contain oligosaccharide incubated under the assay conditions in the absence of enzyme. FIG. 9B illustrates the fingerprints obtained after hydrolysis of Beechwood xylan by wild-type and variant enzymes. Standards contained $(Xyl)_2$, $(Xyl)_3$, $(Xyl)_4$. All assays were performed at 37° C. and pH 5.5.

A combination of laboratory gene evolution strategies was used to rapidly generate a highly active, thermostable xylanase optimized for process compatibility in a number of industrial market applications. GSSM™ methodology was employed to scan the entire sequence of the exemplary "wild type" xylanase SEQ ID NO: 190 (encoded by SEQ ID NO:189) and to identify 9 point mutations that improve its thermal tolerance. Although it had no discernable effect on the hydrolysis product profile of the enzyme, as illustrated in FIG. 9, the addition of the 9 mutations to the protein sequence resulted in a moderate reduction in enzymatic specific activity at SEQ ID NO:190 (the "wild-type")'s temperature optimum. 70° C., see FIG. 9B. Using the GeneReassembly™ method to generate a combinatorial library of the 9 single site amino acid mutants, this reduction in activity was overcome. Ten thermostable variants ($T_m$'s between 89° C. and 94° C.) with activity better than the "9X" variant were obtained from screening the GeneReassembly™ library. With a $T_m$ of 90° C., enzymatic specific activity surpassing wild-type and a product fingerprint unaltered and comparable to SEQ ID NO:190 (the "wild-type"), the 6X-2 variant (SEQ ID NO:380, encoded by SEQ ID NO:379) is particularly notable. To our knowledge the shift in $T_m$ obtained for these variants is the highest increase reported from the application of directed evolution technologies.

SEQ ID NO:380 (the 6X-2 variant) includes the following changes, as compared to SEQ ID NO:190 (the "wild-type"): D8F, Q11H, G17I, G60H, S65V and G68A. SEQ ID NO:379 includes the following nucleotide changes, as compared to the "wild type" SEQ ID NO:189: the nucleotides at positions 22 to 24 are TTC, the nucleotides at positions 31 to 33 are CAC, the nucleotides at positions 49 to 51 are ATA, the nucleotides at positions 178 to 180 are CAC, the nucleotides at positions 193 to 195 are GTG, the nucleotides at positions 202 to 204 are GCT.

In order to gauge the effectiveness of combinatorial mixing versus addition of the point mutants to the desired phenotype, a fitness parameter combining contributions both from changes in enzyme activity and thermostability was calculated for each mutant. The term fitness as described here is not an objective measure that can be compared to other enzymes, but rather a term that allows the measurement of the success of directed evolution of this particular xylanase. Since enzyme fitness, F, is calculated by equally weighting changes in $T_m$ and enzyme activity for this set of variants, the maximum allowable fitness value is 2 ($F_T \leq 1$ and $F_V \leq 1$, see above). In other words, if the variant with the best activity also had the highest $T_m$, its fitness value would be 2. With a fitness value near 2 (see FIG. 10B), the 6X-2 variant (SEQ ID NO:380, encoded by SEQ ID NO:379) is the closest to possessing the best possible combination of thermal stability and enzyme activity. The single site mutation that confers the highest value of fitness is S65V. Although the $T_m$ of the S65V mutant is lower than that of the Q11H mutant (66° C. verses 70° C. respectively), it has a higher fitness value since its specific activity is not reduced relative to wild-type.

Figure 10:
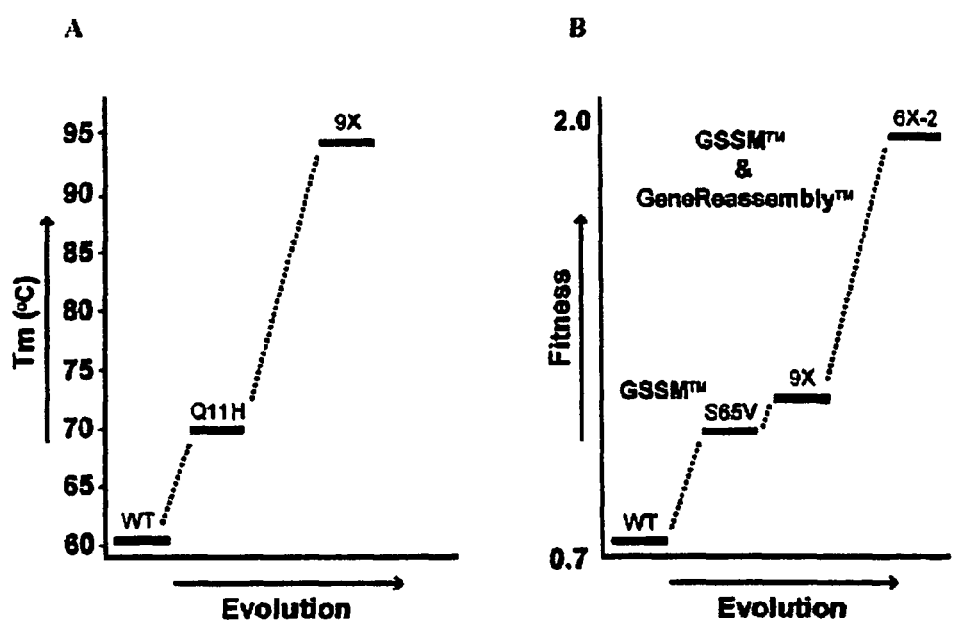
FIG. 10A is a schematic diagram illustrating the level of thermal stability (represented by Tm) improvement over SEQ ID NO:190 ("wild-type") obtained by GSSM™ evolution, as described in detail in Example 5, below.
FIG. 10B illustrates a "fitness diagram" of enzyme improvement in the form of SEQ ID NO:378 and SEQ ID NO:380, as obtained by combining GSSM™ and GeneReassembly™ technologies, as described in detail in Example 5, below.

FIG. 10A is a schematic diagram illustrating the level of thermal stability (represented by Tm) improvement over "wild-type" obtained by GSSM™ evolution. The single site amino acid mutant and the combinatorial variant with the highest thermal stability (Q11H and "9x" (SEQ ID NO:378), respectively) are shown in comparison to wild-type. FIG. 10B illustrates a "fitness diagram" of enzyme improvement obtained by combining GSSM™ and GeneReassembly™ technologies. Fitness was determined using the formula F=FT+FV where fitness (F) is calculated by equally weighting thermal tolerance fitness (FT) and relative activity fitness (FV) as described above. The point mutation that confers the greatest fitness (S65V) is shown. Combining all 9 point mutations also improved fitness (SEQ ID NO:378, the "9X" variant). However, the largest improvement in fitness was obtained by combining GSSM™ and GeneReassembly™ methods to obtain the best variant, 6X-2 (SEQ ID NO:380).

The GeneReassembly™ method also allowed the identification of important residues that appear absolutely necessary for improved thermal stability. Two key residues, Q11H and G17I, were present in every GeneReassembly™ variant identified based on thermal tolerance (see FIG. 6A). The structural determinants for thermal stability of proteins have been studied and several theories have been documented, e.g., by Kinjo (2001) Eur. Biophys. J. 30:378-384; Britton (1999) J. Mol. Biol. 293:1121-1132; Ladenstein (1998) Adv. Biochem. Eng. Biotechnol. 61:37-85; Britton (1995) Eur. J. Biochem. 229: 688-695; Tanner (1996) Biochemistry 35:2597-2609; Vetriani (1998) Proc. Natl. Acad. Sci. USA 95:2300-2305. Hydrogen bonding patterns, ionic interactions, hydrophobic packing and decreased length of surface loops are among the key factors even though the contribution of each to protein stability is not fully understood. Given that most of the beneficial point substitutions identified from testing all possible single amino acid substitutions involved the replacement of relatively polar, charged or small (glycine) residues for much larger hydrophobic residues, it can surmised that hydrophobic interactions play the most significant role in enhancing the thermostability of this protein. Even with a good understanding of the optimal interactions to enhance thermal tolerance, the prediction of where to make mutations that introduce such interactions is not straightforward. A nonrational approach using the GSSM™ method, however, allows rapid sampling of all sidechains at all positions within a protein structure. Such an approach leads to the discovery of amino acid substitutions that introduce functional interactions that could not have been foreseen.

Example 6

Pre-Treating Paper Pulp with Xylanases of the Invention

In one aspect, xylanases of the invention can be used to pretreat paper pulp. This example describes an exemplary routine screening protocol to determine whether a xylanase is useful in pretreating paper pulp; e.g., in reducing the use of bleaching chemicals (e.g., chlorine dioxide, $ClO_2$) when used to pretreat Kraft paper pulp.

The screening protocol has two alternative test parameters: Impact of xylanase treatment after an oxygen delignification step (post-$O_2$ pulp); and, Impact of xylanase in a process that does not include oxygen delignification (pre-$O_2$ brownstock).

For pulp treatment conditions that simulate process conditions in industrial situations, e.g., factories: pH 8.0; 70° C.; 60 min duration.

The process is schematically depicted in the Flow Diagram of FIG. 11.

Twenty xylanases were identified by biochemical tests that were active under these conditions. Of the 20 xylanases, 6 were able to significantly reduce $ClO_2$ demand when they were used to pretreat Kraft pulp before it was chemically bleached. The six are: SEQ ID NO:182 (encoded by SEQ ID NO:181); SEQ ID NO:160 (encoded by SEQ ID NO:159); SEQ ID NO:198 (encoded by SEQ ID NO:197); SEQ ID NO:168 (encoded by SEQ ID NO:167); SEQ ID NO:216 (encoded by SEQ ID NO:215); SEQ ID NO:260 (encoded by SEQ ID NO:259). Others showed some activity but were not as good. Xylanases SEQ ID NO:182 (encoded by SEQ ID NO:181) and SEQ ID NO:160 (encoded by SEQ ID NO:159) are modular and contain a carbohydrate binding module in addition to the xylanase catalytic domain. It was demonstrated that truncated derivatives of these 2 xylanases containing just the catalytic domain are more effective in this application. The best xylanase, SEQ ID NO:160 (encoded by SEQ ID NO:159) was studied more comprehensively. Results can be summarized as follows:

pretreatment of post-$O_2$ spruce/pine/fir (SPF) pulp with 2 units/g of SEQ ID NO:160 (encoded by SEQ ID NO:159) reduces subsequent $ClO_2$ use by 22% to reach 65% GE brightness;

pretreatment of pre-02 brownstock SPF with 0.5 units/g SEQ ID NO:160 (encoded by SEQ ID NO:159) reduces subsequent $ClO_2$ use by 13% to reach 65% GE brightness;

pretreatment of pre-$O_2$ Aspen pulp with 0.5 units/g SEQ ID NO:160 (encoded by SEQ ID NO:159) reduces $ClO_2$ use by at least 22%;

pretreatment of pre-$O_2$ Douglas Fir/Hemlock pulp with 0.5 units/g SEQ ID NO:160 (encoded by SEQ ID NO:159) reduces $ClO_2$ use by at least 22%;

under the treatment conditions employed, the reduction in yield from the xylanase treatment did not exceed 0.5% when compared with pulp that had been bleached at the same kappa factor but not treated with xylanase;

optimal conditions for treating post-$O_2$SPF pulp with SEQ ID NOS:159, 160 were: pH 6-7, enzyme dose 0.3 units/g, treatment time 20-25 min. Under these conditions, reduction in $ClO_2$ use of 28% was possible to reach 69% GE brightness.

In further experiments:
SEQ ID NO:160 (XYLA), encoded by SEQ ID NO: 159=full length wild type xylanase:
XYLA (E.c)=truncated variant of SEQ ID NOS:159, 160 containing only xylanase catalytic domain expressed in *E. coli*
XYLA (P.f)=ditto but expressed in *P. fluorescens*
SEQ ID NO:182 (encoded by SEQ ID NO: 181)=second full-length wild type xylanase:
XYLB (E.c)=truncated variant etc, etc expressed in *E. coli*
XYLB (P.f)=ditto but expressed in *P. fluorescens*

Dose Response Data for Lead Xylanases on Pre-02 Brownstock
Conditions for xylanase stage (X-stage) as follows:
pH 8
Temperature 70° C.
Time 60 min
Kappa factor 0.24
For no-enzyme control, kappa factor was 0.30
Results showed a dose dependent increase in brightness for xylanase-treated samples at a lower charge of chlorine dioxide ($ClO_2$) (Kf 0.24 vs Kf 0.30).
In each case, the truncated derivative looked to be more effective that the full-length xylanase. Optimal xylanase dose looked to be around 0.6 to 0.7 U/g pulp.

Pretreatment of Intercontinental Pre-$O_2$ Brownstock with the Best 4 Xylanases
Determination of $ClO_2$ Dose Response in $D_o$
Experimental outline
Pre-$O_2$ Brownstock
Initial kappa 31.5
X stage conditions
Xylanase charge 0.7 U/gm
Temperature 70° C.
pH 8
Treatment time 1 hr
Pulp consistency 10%
Bleach sequence $XDE_P$
Kappa factor 0.22, 0.26 and 0.30 (% D on pulp: 2.63, 3.12 and 3.60)

Final Brightness after 3-Stage Bleach Sequence Versus Kappa Factor ($ClO_2$ Charge):
XYLB—At 61.5 final brightness, X-stage enables reduction in $ClO_2$ use of 3.89 kg/ton pulp.
XYLB (E.c)—At 61.5 final brightness, X-stage enables reduction in $ClO_2$ charge of 4.07 kg/ton pulp.

XYLA—At 61.5 brightness, X-stage enables a reduction in $ClO_2$ use of 4.07 kg/ton pulp.

XYLA (E.c)—At 61.5 final brightness, X-stage enables reduction in $ClO_2$ use of 4.90 kg/ton pulp.

Determination of $ClO_2$ Dose Response in $D_o$:

| Enzyme | $ClO_2$ Savings in $D_o$ (kg/ton OD) | Kf reduction in $D_o$ |
|---|---|---|
| XYLB | 3.89 | 11.7% |
| XYLB (E.c) | 5.08 | 15.8% |
| XYLA | 4.07 | 12.2% |
| XYLA (E.c) | 4.90 | 14.7% |

Xylanase 0.7 U/g, pH 8.0, 70° C., 1 hr
Pulp: Pre-02 Brownstock, initial kappa 31.5

Percentage saving of $ClO_2$ is of little significance to the industry. Their primary concern is lbs of $ClO_2$ required per ton OD pulp. This makes sense when one considers that a lower percentage saving seen with a high initial kappa brownstock can be more valuable in terms of lbs of $ClO_2$ saved than a higher percentage reduction for a low initial kappa pulp which will require a lower total charge of $ClO_2$ to reach target brightness.

Relationship between Brightness, Yield and Kappa Factor for Bleached Control Pulp:

The results showed that bleaching with increasing doses of $ClO_2$ to achieve higher target brightness results in increased loss of pulp yield. This is an issue because pulp at this stage of the process has a value of almost $400 per ton and loss of cellulose costs money.

A benefit of xylanase (e.g., a xylanase of the invention) is that use of a lower $ClO_2$ dose can reduce yield losses as long as the action of the xylanase itself doesn't cancel out the gain.

Dose Response Data for Pretreatment of Pre-07 Brownstock with Xylanase XYLB (P.f):

Experimental outline
  Northwood Pre-02 Brownstock
  Initial kappa 28.0
  Initial consistency 32.46%
  Initial brightness 28.37
  X stage conditions
  Xylanase charge 0 to 2.70 U/gm
  Temperature 58° C. to 61° C.
  pH 8.2 to 8.5
  Treatment time 1 hr
  Bleach sequence $XDE_p$
  Kappa factor 0.24
  $ClO_2$ saving calculated for Kappa factors between 0.24 and 0.30

The purpose of this experiment was to evaluate the best of the 4 xylanases on unwashed SPF brownstock. Results showed dose-dependent increases in final brightness for pulp treated with XYLB (E.c), with brightness achieved in presence of xylanase at lower Kf of 0.24, approaching brightness achieved at higher Kf of 0.30 asymptotically.

Relationship Between Dose of Xylanase XYLB (E.c) and Chlorine Dioxide Saving (Pre-$O_2$ Brownstock):

| $ClO_2$ Saving in % OD Pulp | $ClO_2$ Saving in kg/ton Pulp | Xylanase Dose in U/gm |
|---|---|---|
| 0.299% | 2.99 | 0.31 |
| 0.363% | 3.63 | 0.51 |
| 0.406% | 4.06 | 0.71 |
| 0.439% | 4.39 | 0.91 |
| 0.483% | 4.83 | 1.26 |
| 0.523% | 5.32 | 1.80 |
| 0.587% | 5.87 | 2.70 |

Optimum Xylanase Dose is between 0.5 and 0.9 U/gm

The optimum dose lies in the range 0.5 to 0.9 U/g. Above this dose there is a diminishing return per unit increment of xylanase. Reductions in chlorine dioxide dose per ton of pulp treated of this magnitude are commercially significant.

Three-Stage Biobleaching Procedure

A three-stage biobleaching procedure was developed that would closely simulate the actual bleaching operations in a pulp mill bleach plant (FIG. 1). This bleach sequence is designated by (X)DoEp, in which X represents the xylanase treatment stage, D for chlorine dioxide bleaching stage, and Ep for alkaline peroxide extraction stage. The primary feedstock used in our application tests was Southern Softwood Kraft Brownstock (without oxygen delignification). The most effective xylanase candidates that showed high bleach chemical reduction potential in the biobleaching assays were also tested on two species of hardwood Kraft pulp (maple and aspen). Upon completion of each biobleaching round, the ensuing pulp was used to produce TAPPI (Technical Association of Pulp and Paper Industries)-standard handsheets. The GE % brightness of each handsheet was measured, and the brightness values were used as the indication of how well each enzyme had performed on the pulp during the enzymatic pretreatment stage (X).

Results:

Out of approximately 110 xylanases that were screened using the (X)DoEp biobleaching sequence, 4 enzymes, i.e., XYLA (P.f); XYLB (P.f); SEQ ID $NO_{216}$ (encoded by SEQ ID NO:215); SEQ ID NO:176 (encoded by SEQ ID NO:175); showed the greatest potential for reducing the use of bleaching chemicals. While XYLA (P.f) and XYLB (P.f) exhibited equally high performance (best among the four good performers), XYLA (P.f) showed a better pH tolerance than XYLB (P.f). The results can be summarized as follows:

It is possible to achieve a handsheet brightness of 60 (GE %) using a three-stage bleach sequence [(X)DoEp] that involves pretreatment of Southern Softwood Kraft Brownstock with the following four enzymes at the loading levels listed below (pH=8, 65° C. & 1 h):
  XYLA (P.f) at 0.55 U/g pulp
  XYLB (P.f) at 0.75 U/g pulp
  SEQ ID NOS:215, 216 at 1.80 U/g pulp
  SEQ ID NOS:175, 176 at 1.98 U/g pulp Pretreatment of Southern Softwood Kraft Brownstock with 2 U/g pulp of XYLA (P.f) reduces $ClO_2$ use by 18.7% to reach a final GE % brightness of 61.

XYLA (P.f) exhibits good tolerance at higher pH and provides more than 14% chemical savings when the enzymatic pretreatment stage is run at pH=10.

Pretreatment of Southern Softwood Kraft Brownstock with 2 U/g pulp of XYLB (P.f) reduces $ClO_2$ use by 16.3% to reach a final GE % brightness of 60.5.

Pretreatment of aspen Kraft pulp with 2 U/g pulp of XYLA (P.f) and XYLB (P.f) reduces $ClO_2$ use by about 35% to reach a final GE % brightness of 77.

Pretreatment of maple Kraft pulp with 2 U/g pulp of XYLA (P.f) and XYLB (P.f) reduces $ClO_2$ use by about 38% to reach a final GE % brightness of 79.

The two best performing xylanases, namely XYLA (P.f) and XYLB (P.f), are truncated enzymes, containing just the catalytic domain, and were produced in *Pseudomonas fluorescens*.

While the invention has been described in detail with reference to certain preferred aspects thereof, it will be understood that modifications and variations are within the spirit and scope of that which is described and claimed.

SEQUENCE LISTING (380 sequences)

SEQ ID NO: 1 - DNA, 1128 bp, Bacteria
atgaccgaccacaacgcttccgaaaccagcctgttcgaacagtgcggctacagccgcgaggccatccaggcccgcctggagcgcaactggtatgagatgttcgaaggcccggacaagatttactgggagaacgacgaaggcctggggtacgtgatggacaccggcaaccacgacgtgcgcaccgagggcatgagctacgcgatgatgatcgccgtgcagtacggccgcaaggacgtgttcgacaagctgtggggttgggtcatgaaatacatgttcatgaccgagggcctgcaccagggctacttcgcctggtctgtggaccccagcggcgtaccgaacgccgacggtccggccccggacggcgaggaatacttcgcgatggacctgttcctggcctccgcgcgatggggcgacggcgaaggcgtgtacgagtactcccgccacgcccgctcgatcctccacacctgcgtgcaccagggcgaggacggtgaaggctatccgatgtggaacccggagaaccatctgatcaagttcatcccggaaaccgaatggaccgacccgtcctaccatctgccgcacttctacgaggtgttcgccgagcgcgccgacgaggccgaccgtccgttctgggcgcaggccgccaaggcgagccgcgagtacctggtcaccgcctgccacccgcagaccggcatgaaccccgaatactcaaactatgatggcacgccgcacgtcgacgagcgcgaccactggcatttctactccgacgcctaccgcaccgccggcaacatcgggctggactgcctgtggaacggcgtcgtgccggaactgtgcgatgcgaatgcgcgtctgcagcgtttcttcctcgaacacgaccgcacctgcgtgtatgcgatcgacggcacgccggtggacgagaccgtgctgcacccggtcggcttcatcgccgccaccgccgaaggctcgctcgccgcgatgcactcgcaggagccggacgcgctcgacaacgcgatccgctgggtgcgcctgctgtgggacaccccgatccgcaccggcacgcgccgctactacgacaacttcctctacgccttcgcgttcctggcgctggcgggggagtaccgcacctggtga

SEQ ID NO: 2 - protein, 375 aa, Bacteria
MTDHNASETSLFEQCGYSREAIQARLERNWYEMFEGPDKIYWENDEGLGYVMDTGNHDVRTEGMSYAMMIAVQYGRKDVFDKLWGWVMKYMFMTEGLHQGYFAWSVDPSGVPNADGPAPDGEEYFAMDLFLASARWGDGEGVYEYSRHARSILHTCVHQGEDGEGYPMWNPENHLIKFIPETEWTDPSYHLPHFYEVFAERADEADRPFWAQAAKASREYLVTACHPQTGMNPEYSNYDGTPHVDERDHWHFYSDAYRTAGNIGLDCLWNGVVPELCDANARLQRFFLEHDRTCVYAIDGTPVDETVLHPVGFIAATAEGSLAAMHSQEPDALDNAIRWVRLLWDTPIRTGTRRYYDNFLYAFAFLALAGEYRTW

SEQ ID NO: 3 - DNA, 2196 bp, Unknown
  Obtained from an environmental sample
atgttcaaagaatggggaaagaccgactcggaaattaccacaaaagtaaacaccgcgtggaacaaactgtttgttaacggggtggaatccggagataatgccgaaagaatctatgtagagactggaagcgacatggcgtacatccatacctttgacagcaacgacgtgcgctccgaaggaatgtcctacggcatgatgatgtgcgtacagatgaacgatcagacaagatttaacaaactctggaaatgggcaagaacctatatgtacaatgaaacagacgccggcagtaattccaggggctatttctcatggcagtgcagtacaagcggctcaaaaatggataagggccccgctcctgacggcgaggaatactttattacggcgctgttgttcgcgcacgcccgctgggggagcgcgtccggtactacaaacataaacaattacgcgcagcaagcaaggcagattatctatgacttaacgcgccgcaaaccggggaacggagatccttacggcgagccttcaatgtttaatgtagacaactatatggttagattcgccacacttggaaattccgccacctttacagacccctcataccatttaccggcattctatgatgtttgggcgctggaattacaggcggactatgataatagtaaactctacggtatctgggctgataaggctgacttgaaaaaagacattgattactttaaacaagcggcgaccacaagccgttcattctttgcaaaaacgacaaacggtacaaccggacttggaccggattatgccggctttgacggaacgcctaaaaatgaaggggatcacaagtatttcgagtatgacgcgtggcgtatcgcgatgaacataggtatggactacgcgtggttcgcgaaagattcctggcagaagacatttgccgacagaattcaggcgttctttgtcagcaagggagtcacttcttacggaaaccgctggacattggacgggactcaaaggggagcggatcactcgccgggtcttgtcggctgtaacgcggtcgcctctctcgcggcgacaaacgcgaacgcgtggaaatttatcgaagacttctggaacatcagcatgacgaaaggcaaataccgttactatgacggatgtctgtatatgatgagcatgctgcacttaagcggcaactttaaggcgtatctttctacaaataccacgcccgccaacagttccagcattaccccgacaaccgcgtctttcgacaagaagacaagcgcacaagccgacattgccgtaacagtgacgcttaacgggaatacattctcaagtatcacaaacaacggtacagcccttacaagcggcacagactactcagtgagtggaacaaagtatacgataaagaaagaataccttgcaaaacagcctgtaggaacaacgaagctcgcattcaacttcagtgccggaggaactccggaacttacagttactataacggacacgggcagctccagcatcagcccgacaaccgcgacattcgacaaaaagaccggagcgcaagccgacatcgccgtaaccatgacgcttaatgggaatactttgtcgaacatcaaaaacggttctgcacaacttacaagcggaactgactactcaacgagcggcagtacggtaacgattaaaaaagaatacctggcaaagcaggctaacggcacagtaacgcttaccttcacattcagcgcaggcgcggcccaaactattgacatcacggtaaaagatacaaccggcggagcggcgggaataaaatacaacttcgcaactgacaacctgcccaacgggtacccgaagtacagttcaagtgatatatccgcgacaataaccggaggagctttggtaataaccaaaaccggaaataattcgtccccgaagattacattgccctttagtgtaacaggtaacctttccggttatacaggcataaagataaatgtaaagggagtatccggagatttcacttataaagtattgaatgccgcaataggttctacaaatctcggcagcgtaaataacgccccaataccaaacggctcatttggagacgtaacaataccaataaccggcggtacaaacaccggagatttagatatatcgttctggctcaataacacaaatgcttacgttattgagattaagagcatagagctggtaaaatga

SEQ ID NO: 4 - protein, 711 aa, Unknown
  Obtained from an environmental sample
MFKEWGKTDSEITTKVNTAWNKLFVNGVESGDNAERIYVETGSDMAYIHTFDSNDVRSEGMSYGMMMCVQMNDQTRFNKLWKWARTYMYNETDAGSNSRGYFSWQCSTSGSKMDKGPAPDGEEYFITALLFAHARWGSASGTTNINNYAQQARQIIYDLTRRKPGNGDPYGEPSMFNVDNYMVRFATLGNSATFTDPSYHLPAFYDVWALELQADYDNSKLYGIWADKADLKKDIDYFKQAATTSRSFFAKTTNGTTGLGPDYAGFDGTPKNEGDHKYFEYDAWRIAMNIGMDYAWFAKDSWQKTFADRIQAFFVSKGVTSYGNRWTLDGTQRGADHSPGLVGCNAVASLAATNANAWKFIEDFWNISMTKGKYRYYDGCLYMMSMLHLSGNFKAYLSTNTTPANSSSITPTTASFDKKTSAQADIAVTVTLNGNTFSSITNNGTALTSGTDYSVSGTKYTIKKEYLAKQPVGTTKLAFNFSAGGTPELTVTITDTGSSSISPTTATFDKKTGAQADIAVTMTLNGNTLSNIKNGSAQLTSGTDYSTSGSTVTIKKEYLAKQANGTVTLTFTFSAGAAQTIDITVKDTTGGAAGIKYNFATDNLPNGYPKYSSSDISATITGGALVITKTGNNSSPKITLPFSVTGNLSGYTGIKINVKGVSGDFTYKVLNAAIGSTNLGSVNNAPIPNGSFGDVTIPITGGTNTGDLDIS

SEQ ID NO: 5 - DNA, 2106 bp, Unknown
  Obtained from an environmental sample
atgcaaaacctatttaagcgtgtgtttttccatcttctcttgcttgccttgctggcaggctgtgctggcccttctcccgtaacaccggagccgaccgaaatgccgacccaggtccctacaccaacgcctagtcttggcgcctacgagagcggcgagtatcgcaacctgttcgccgaggcgcttggcaaatcggatgccgaaattcaggccaaaatcgatgccgctttccaacaacttttctacggcgacgatgtttctgagcgcgtctattacccggttggcagcgacatgggctatatgctcgacaccggcaacgacgatgtgcgctccgagggcatgtcctacggcatgatgattgccgtccagatgaacaagaaggaagaattcgaccgcatctggaagtggaccaaaacctacatgtaccagaccgaaggtggttacaaaggttattttgcctggcacgctaaaacggacggcacccaactggccgccaacccggcctctgacggtgaagtctggtttgtgatggcgctcttctttgccgatgcgcgttggggcagcggcgaaggaatttataactaccgcgcccaagcccaggaaattctcgatgtggccttgaacgccaaagaattgggcggcaacctggcgaccaacctgttcgacccggagaccaaacaggtcgtttttgtgccgcagttgggcaataactcgaaatttaccgacgcttcgtaccacatgccccatttctacgagttgtgggcgcgttgggccgataaaaataacgacttttgggccgaagccgctaccgttagccgcgagttcctgcctactgccgttcaccccgaaaccggcctggcccctaactattcctacttcgatggccgcccttacaatgacgagtatcacggccagttccgctacgacgctttccgcgtgggcgcgaacatcggcatggattatgtctggtttcacccctctgaatggtatcgggaacaagccaaccgccaattatctttcttcgcatcccagggcatcgatgattatgttgccgaatattccctggatggaaaaccgctggccgggcatcgcgctacggggttgattgccaccaatgctgtcctggcctacgccgcagaccccgaaattggtcaacccttcgtccaggccctgtgggatgcagagcctccgactggcaggtatcgctactatgacggcctgctctacatgatgggcctgctgcaagccagcggcaacttccgtatttacgagccgggtattacgcctcgcgctgagttgccgcccccgccgcctcgcgccatcgagggccgcttcgcgcccattaccgggcgggccttgcttctgattggcccgaatgcggatggcgtcaacgcttacttcgacaaactggtgacagcgccgggcggcgtgaatgtcgaactatcgctcaaatcgcctgatttggaagcgctcgacgccctggcgaggaaatatcccaacagcacgctttcggtcgggttgtcgctggatggcccggtaacagaggcggatgcgcgggtgggagaattgctcgacgcgttggctgtttatccgcgcccggtcttcctgcgcatcgggccggaatttgatttggcggcgagcggccaggggccggaggaatatgtcgcggcctggaaaacgctccataacgagattcaggcgcggggtagttcgaatatcgccctggtgtggcatagcgccgcagcctgcgagtcgccctttggcggtcatccgctcgaagcgtggtatcccggtgatgagtttgtggattgggtggccgtttcgcgcactgcgcagtctgccgattgcgaggggcagtccgttgaggccgtcttgcagtttgcgcgtgagcgatacaaaccggttgtgttggttgcatcgccagcagaggacatcttcgagttcgtttacgccaacaacgacgtgattcgcgccctgctgtatctgaacaccgagccgggcctgttcgacacccccgaatttttgagcggctggaaggccgaaatcggtcagcagttctggctgcgcggcggcccggcgcttttttcgacactcggattggatgagtaa

SEQ ID NO: 6 - protein, 701 aa, Unknown
  Obtained from an environmental sample
  SIGNAL (1)...(47)
MQNLFKRVFFHLLLLALLAGCAGPSPVTPEPTEMPTQVPTPTPSLGAYESGEYRNLFAEALGKSDAEIQAKIDAAFQQLFYGDDVSERVYYPVGSDMGYMLDTGNDDVRSEGMSYGMMIAVQMNKKEEFDRIWKWTKTYMYQTEGGYKGYFAWHAKTDGTQLAANPASDGEVWFVMALFFADARWGSGEGIYNYRAQAQEILDVALNAKELGGNLATNLFDPETKQVVFVPQLGNNSKFTDASYHMPHFYELWARWADKNNDFWAEAATVSREFLPTAVHPETGLAPNYSYFDGRPYNDEYHGQFRYDAFRVGANIGMDYVWFHPSEWYREQANRQLSFFASQGIDDYVAEYSLDGKPLAGHRATGLIATNAVLAYAADPEIGQPFVQALWDAEPPTGRYRYYDGLLYMMGLLQASGNFRIYEPGITPRAELPPPPPRAIEGRFAPITGRALLLIGPNADGVNAYFDKLVTAPGGVNVELSLKSPDLEALDALARKYPNSTLSVGLSLDGPVTEADARVGELLDALAVYPRPVFLRIGPEFDLAASGQGPEEYVAAWKTLHNEIQARGSSNIALVWHSAAACESPFGGHPLEAWYPGDEFVDWVAVSRTAQSADCEGQSVEAVLQFARERYKPVVLVASPAEDIFEFVYANNDVIRALLYLNTEPGLFDTPEFLSGWKAEIGQQFWLRGGPALFSTLGLDE

SEQ ID NO: 7 - DNA, 1539 bp, Unknown
  Obtained from an environmental sample
atggcacgtttaatcacctattgcttgatcggcgtcttactcgtgatgccagtccttgccgcttgcagcacagcacctacgccaacgctgatgagccagccaacttccacgccgcaaccggccctgcaaccgacgccaccaccgacgagcgtcccccggtcgatcggggcgtttgagtccggtcagtatcgtaatctcttcacggaattactgggcaagagcgaggccgagattcagcagaagatcgatcaggcgtgggcgcagttgttctacggcgacaacgacacgcagcgcgtttactatcccgtgggtcgcgacagggcctacatcaaagacatcggcaacaatgatgtgcgcagtgagggtatgtcgtacggtatgatgctggcggtgcagctggacaagcaggaagagttcaacaaattgtggaagtgggcgcacacctatatgctgcaaaaggatggcccgtacaaaggctattttgcgtggcatgccaatgagaacggtgaacagctggatgcgggtcccgcctccgatggcgaagagtggtttgtcatggcactgctcttcgcggcaaatcgctggggcaacggtgaaggcatctttaattatcaggccgaggcgcagaagatcctggatgtgatgctgcataagagcgaagaggacaacggtctcgccaccagcatgttcgatccggacacgaagcaggtggtgtttgtgccggccgggcgccaggccacattcaccgatccgtcttatcacttgcccgcgttctatgaactgtgggcgcgctgggctgacaaggataacgatttttggaaagaagcggcgcaggccagccgcgaattttggaagaaggcggcgcatccggaaacgggcctgatgtctgactacgccgagtttgacggcagaccccaggccgattctgaacacaaggattttcgctatgacgcgttccgtgtggcgtccaatgtggcgctcgattgggcctggttcgccgccgatccgtgggaggtggaacagagcaatcggttgttggatttcttccgttcacaaggcatggataagtatccgagtctatacaacatcgatggcacgccgttatccactaatcgctcgccgggtttgatcgccatgaacgccacagctggactcgcggctgatccggaaaagagcaaggactttgtgcaggcgctatgggatctggaaattcccagcggacaatggcgctattacgatggggtgctgtatttcctggcgctgttgcaagccagcggcaactatcgcatctacacgcccgatatgcccaaggtggtgcggcccacacctacgcccgatccgatcacgcaagcgaaatttgcacccggcgatgacgcggtgctgttcagtgtggaaacagatgcactcgacgaatatgtgacggcgacgggctttgagccgggcggcgtgatgttgaacactactttggacagcgcctcttttgacgcaccactgcctgacagcgctctgctgatcggattggacgtcagcgatcaataa

SEQ ID NO: 8 - protein, 512 aa, Unknown
  Obtained from an environmental sample
  SIGNAL (1)...(57)
MARLITYCLIGVLLVMPVLAACSTAPTPTLMSQPTSTPQPALQPTPPPTSVPRSIGAFESGQYRNLFTELLGKSEAEIQQKIDQAWAQLFYGDNDTQRVYYPVGRDRAYIKDIGNNDVRSEGMSYGMMLAVQLDKQEEFNKLWKWAHTYMLQKDGPYKGYFAWHANENGEQLDAGPASDGEEWFVMALLFAANRWGNGEGIFNYQAEAQKILDVMLHKSEEDNGLATSMFDPDTKQVVFVPAGRQATFTDPSYHLPAFYELWARWADKDNDFWKEAAQASREFWKKAAHPETGLMSDYAEFDGRPQADSEHKDFRYDAFRVASNVALDWAWFAADPWEVEQSNRLLDFFRSQGMDKYPSLYNIDGTPLSTNRSPGLIAMNATAGLAADPEKSKDFVQALWDLEIPSGQWRYYDGVLYFLALLQASGNYRIYTPDMPKVVRPTPTPDPITQAKFAPGDDAVLFSVETDALDEYVTATGFEPGGVMLNTTLDSASFDAPLPDSALLIGLDVSDQ

SEQ ID NO: 9 - DNA, 1311 bp, Unknown
  Obtained from an environmental sample
atgtttccacgtctttcaccaagccgcttcaggcaagttaccttaaccttgctcacgctcggccttgtgtcactgaccggttgtgcaggtaacagcaagccggatgcagacaccagtactgctggtgccgttgctaccggcgagtaccgcaatctgtttgccgaaatcggaaaaagcgaaatagacatccagcgcaaaattgacgaggcgtttcagcacttgttttatggcgacgcgaaagatgcagctgtctactatcaagcgggtggaaacgagaatggtccactcgcatatgtttacgatgtgaacagcaatgacgtgcgctcagaaggcatgagctacggcatgatgattactgttcaaatggacaaaaaagccgagttcgatgcaatctggaactgggcgaaaacctatatgtatcaagactcccccacgcatccagcgtttggttactttgcctggtccatgcgccgcgatggtgtcgccaatgacgatatgccagcgccagatggcgaggaatatttcgtgaccgctctctatttcgccgccgcccgctggggtaatggcgaaggtattttcaactaccaacaggaagcggacaccattttgagccgcatgcgccaccgccaggtgatcaccggcccaaccaatcgcggagtaatgactgcgaccaatctgttccacccggaagaggcgcaagtgcgcttcacgcccgacatcaataatgctgatcatacagacgcgtcttaccatctgccctcgttctatgaaatttgggcacgtgtcgcgccgcaagaagatcgcgcgttttgggccaaagcggccgatgtgagccgcgactattttgccaaagccgcccaccctgtcactgcgttaacaccggactacggtaattttgatggcaccccgtgggcggcatcctggcggccggagtcggtagattttcgatacgatgcctggcgttccgtcatgaactggtccatggactatgcctggtggggcaaagattcaggcgcacctgcgcgcagtgataaattactcgcgttcttcgaaacccaggaaggcaaaatgaaccacctctatagcctggatggcaaaccgctgggtggtggaccgaccctcggcctaatttccatgaatgcaacggcagctatggcagctactgatccccgctggcacaattttgtggaaaagctctggcaacaacaaccccccacagggcaataccggtactacgacggtgttctatacctgatggcgctgctacattgcgctggggagtacaaagcgtggatccccgacggggaataa

SEQ ID NO: 10 - protein, 436 aa, Unknown
  Obtained from an environmental sample
  SIGNAL (1)...(36)
MFPRLSPSRFRQVTLTLLTLGLVSLTGCAGNSKPDADTSTAGAVATGEYRNLFAEIGKSEIDIQRKIDEAFQHLFYGDAKDAAVYYQAGGNENGPLAYVYDVNSNDVRSEGMSYGMMITVQMDKKAEFDAIWNWAKTYMYQDSPTHPAFGYFAWSMRRDGVANDDMPAPDGEEYFVTALYFAAARWGNGEGIFNYQQEADTILSRMRHRQVITGPTNRGVMTATNLFHPEEAQVRFTPDINNADHTDASYHLPSFYEIWARVAPQEDRAFWAKAADVSRDYFAKAAHPVTALTPDYGNFDGTPWAASWRPESVDFRYDAWRSVMNWSMDYAWWGKDSGAPARSDKLLAFFETQEGKMNHLYSLDGKPLGGGPTLGLISMNATAAMAATDPRWHNFVEKLWQQQPPTGQYRYYDGVLYLMALLHCAGEYKAWIPDGE

SEQ ID NO: 11 - DNA, 1224 bp, Unknown
  Obtained from an environmental sample
atgcggaacgtcgtgcgtaaaccattgacaatcggactcgctttaacactattattgcccatgggaatgacggcaacatcagcgaagaatgcagattcctatgcgaaaaaacctcacatcagcgcattgaatgccccacaattggatcaacgctacaaaaacgagttcacgattggtgcggcagtagaaccttatcaactacaaaatgaaaaagacgtacaaatgctaaagcgccacttcaacagcattgttgccgagaacgtaatgaaaccgatcagcattcaacctgaggaaggaaaattcaattttgaacaagcggatcgaattgtgaagttcgctaaggcaaatggcatggatattcgcttccatacactcgtttggcacagccaagtacctcaacggttctttcttgacaaggaaggtaagccaatggtcaatgaaacagatccagtgaaacgtgaacaaaataaacaactgctgttaaaacgacttgaaactcatattaaaacgatcgtcgagcggtacaaagatgacattaagtactgggacgttgtaaatgaggttgtgggggacgacggaaaactgcgcaactctccatggtatcaaatcgccggcatcgattatattaaagtggcattccaagcagctagaaaatatggcggagacaacattaagctttacatgaatgattacaatacagaagtcgaaccgaagcgaaccgctctttacaatttagtcaaacaactgaaagaagagggtgttccgatcgacggcatcggccatcaatcccacatccaaatcggctggccttctgaagcagaaatcgagaaaacgattaacatgttcgccgctttcggtttagacaaccaaatcactgagcttgatgtgagcatgtacggttggccgccgcgcgcttacccgacgtatgacgccattccaaaacaaaagtttttggatcaggcagcgcgctatgatcgtttgttcaaactgtatgagaagttgagcgataaaattagcaacgtcaccttctggggcatcgccgacaatcatacgtggctcgacagccgtgcggatgtgtactatgacgccaacgggaatgttgtggttgacccgaacgctccgtacgcaaaagtggaaaaagggaaaggaaaagatgcgccgttcgtttttggaccggattacaaagtcaaacccgcatattgggctattattgaccacaaatag

SEQ ID NO: 12 - protein, 407 aa, Unknown
  Obtained from an environmental sample
  SIGNAL (1)...(28)
MRNVVRKPLTIGLALTLLLPMGMTATSAKNADSYAKKPHISALNAPQLDQRYKNEFTIGAAVEPYQLQNEKDVQMLKRHFNSIVAENVMKPISIQPEEGKFNFEQADRIVKFAKANGMDIRFHTLVWHSQVPQRFFLDKEGKPMVNETDPVKREQNKQLLLKRLETHIKTIVERYKDDIKYWDVVNEVVGDDGKLRNSPWYQIAGIDYIKVAFQAARKYGGDNIKLYMNDYNTEVEPKRTALYNLVKQLKEEGVPIDGIGHQSHIQIGWPSEAEIEKTINMFAAFGLDNQITELDVSMYGWPPRAYPTYDAIPKQKFLDQAARYDRLFKLYEKLSDKISNVTFWGIADNHTWLDSRADVYYDANGNVVVDPNAPYAKVEKGKGKDAPFVFGPDYKVKPAYWAIIDHK

SEQ ID NO: 13 - DNA, 1053 bp, Unknown
  Obtained from an environmental sample
atgaaagacgcgctccagtgctctccccttttcaaagcctatgaaaaatacttccgcatcggcgcggcggttagcagcttcatgacctttgatcccgcttaccgcgccctgatccgccgccattacaattccctgacggcggacaaccagatgaagccggaaagcgtgttggatcgcaccgcgaccctggcgaagggcgacctgctccacgctgcggtggatttcacccgtgtggacgcgctgatgtactttgcacgggacaacgggatccccatgcggtatcacaccctggcctggcacaaccagacgccccgctggttcttcgcgaaggactggagcgacgcggaaagcgccgaacccgcctcaaaggaaaccatgcttgcccgtctggaaaactatatcctggatgtcatgaaccatgtgaataccaagtttcccggtctggtttacacctgggacgtggtaaacgaagccattgagccagagctgaaagccccgggattgtaccggacctggagcccctggttcaaaacctgcggagaagatttcctctttaccgctttccgggccgcccgcaagggacaggcgcccggtcagaccctttgctataacgactataacgccttcgagcccgtcaagcgggacgcgattatcgatctgctgaagaagctgcaggcggaaaacctggtggataccatgggtatgcaggggcattatgtcatggactggatgaacatctcgctctgcgaagaggccgcccgcgcctatgccgccctgggcctgaaggtccaggtcaccgagctggatatccactgcaacagcgacgatgaagcccacagccaaaagctggcgcagctttacggcgattatttcgccatgctgaagaagctgaaggaggaaggcgtcgacatcgaagccgtcaccttctggggcgtcaccgaccaggacagctggctcaccggtttccgtaaagagacaagctatcccctcctcttcgaccgcgccaagcaggccaaggatgcctatgacgccgtcatgaaagccgcggaataa

SEQ ID NO: 14 - protein, 350 aa, Unknown
  Obtained from an environmental sample
MKDALQCSPLFKAYEKYFRIGAAVSSFMTFDPAYRALIRRHYNSLTADNQMKPESVLDRTATLAKGDLLHAAVDFTRVDALMYFARDNGIPMRYHTLAWHNQTPRWFFAKDWSDAESAEPASKETMLARLENYILDVMNHVNTKFPGLVYTWDVVNEAIEPELKAPGLYRTWSPWFKTCGEDFLFTAFRAARKGQAPGQTLCYNDYNAFEPVKRDAIIDLLKKLQAENLVDTMGMQGHYVMDWMNISLCEEAARAYAALGLKVQVTELDIHCNSDDEAHSQKLAQLYGDYFAMLKKLKEEGVDIEAVTFWGVTDQDSWLTGFRKETSYPLLFDRAKQAKDAYDAVMKAAE

SEQ ID NO: 15 - DNA, 1110 bp, Unknown
  Obtained from an environmental sample
atgaaacgtcctctagtcaatctcctgacaaccgcctgcctcctcgttgccgcaaatgctgcagaacccaccctccgcgaagcctacgaaaagcactttgccgtgggtgtcgcactcaataccgctcaagtgactggtcgaaacaaagccgcaggcgaactcgccgcgaagcagttcaattccatcaccgctgagaatgacatgaagtggcaatcgcttcatccagagctcgatacctaccgctttgaatcggccgatgcctatatcgactttgccaaaaagaatgagatggaagtcataggccacactctcgtctggcacagccagacccctcagtgggtgttccaaggcgacgatggcaaacccgcgacacgggaagaacttctcaagcggatgcgcgatcacattcacaaggtcgccggccgatacaagggtaaggtcaagggctgggacgtcgtcaatgaggcgctctccgacggaggtcaggacattctacgcgaatctccgtggcggcgaatcatcggagacgatttcatcgatcacgctttccgctacgcccgcgaagccgacccaaaggcagaactttactacaacgactacaacctcgaaatccctcgcaaacgcgagaactgcatcaagctcgtcaagggcatgcttgagcgcggcgtccccatcgacggcattggaacgcaatcccattttcagcttggcttcccatcgctggaagatgtcgagaccacgattgaagagtttggaaaactcggccttaaggtcatgattaccgaactcgatgtggatgtcctccctcgcaataacccaggcgtcgccgacatcagtcagcgcgagcaaggtagcaatccctacactgagggcctgcccgaggatgttcaaaagcagcttacgaaacgctacgaagacatcttcaagatctacctaaagcaccagaaaacggtcacccgcgtgaccttctggggcctcgatgatggtcaatcatggttgaatggctttcctgttagaggccgcaccaatcacccgctacttttcgatcgtgaactcaaaccgaagcccgttcttccagtcttgatagagctcggcaagaagaagcgataa

SEQ ID NO: 16 - protein, 369 aa, Unknown
  Obtained from an environmental sample
  SIGNAL (1)...(20)
MKRPLVNLLTTACLLVAANAAEPTLREAYEKHFAVGVALNTAQVTGRNKAAGELAAKQFNSITAENDMKWQSLHPELDTYRFESADAYIDFAKKNEMEVIGHTLVWHSQTPQWVFQGDDGKPATREELLKRMRDHIHKVAGRYKGKVKGWDVVNEALSDGGQDILRESPWRRIIGDDFIDHAFRYAREADPKAELYYNDYNLEIPRKRENCIKLVKGMLERGVPIDGIGTQSHFQLGFPSLEDVETTIEEFGKLGLKVMITELDVDVLPRNNPGVADISQREQGSNPYTEGLPEDVQKQLTKRYEDIFKIYLKHQKTVTRVTFWGLDDGQSWLNGFPVRGRTNHPLLFDRELKPKPVLPVLIELGKKKR

SEQ ID NO: 17 - DNA, 1035 bp, Bacteria
atgtcccggcacgtcatcgccctgtccgccgccgtctgcctcgcggccggcctcgccgccgcgcccgcgagcgccgagccgcgtccccggacgctcggcgaactggccaagaagcaccacaagtacttcggctcggccaccgacaaccccgagttcaccgacgccgcctatctgaagctcctcggcagcgagttcgggcagaccacccccggcaacgccatgaagtggtacgccaccgaacccgcgcccggcgtcttcgacttcaccgcgggcgacgaggtcgtggccttcgccaaggcccatcaccagaaggtccgcggccacaccctcgtctggcacagccagctccccgcctggctcaccgagcgcagctggaccgccgcggaactgcgccccgtcctcaagaatcacatccagaaggtggcccggcactacaagggcaaggtcatccactgggacgtcgtcaacgaggccttcaacgaggacggcacctaccgcgagtcggtcttctacaagacgctcggccccggctacatcgccgacgccctgcgctgggcccacgaggccgacccgcacgccaagctgtacctcaacgactacaacgtcgacgggatcggccccaagagcgacgcctactaccgcctgatcaagcagctgaaggccgacggcgtcccggtggagggcttcggcatccaggggcacctggcgctccagtacggcttccccgccgacgtcaagcagaacatgcagcgcttcgccgacctcggcgtcgaggtcgcggtcaccgagctcgacatccggatgaacctcccggcgaccccttcgatgctcgccacccaggccacctggtacgccgactacgtcaaggcctgcctggaggtcaggaagtgcgtcggcgtcaccatctgggactacaccgacaagtactcgtggatcccctccgtcttccccggtgagggcgccgcgctgccctacgacgagaacctggcgcccaagcccgcctaccacgcgatcaggaaggtgctgggcggatga

SEQ ID NO: 18 - protein, 344 aa, Bacteria
  SIGNAL (1)...(31)
MSRHVIALSAAVCLAAGLAAAPASAEPRPRTLGELAKKHHKYFGSATDNPEFTDAAYLKLLGSEFGQTTPGNAMKWYATEPAPGVFDFTAGDEVVAFAKAHHQKVRGHTLVWHSQLPAWLTERSWTAAELRPVLKNHIQKVARHYKGKVIHWDVVNEAFNEDGTYRESVFYKTLGPGYIADALRWAHEADPHAKLYLNDYNVDGIGPKSDAYYRLIKQLKADGVPVEGFGIQGHLALQYGFPADVKQNMQRFADLGVEVAVTELDIRMNLPATPSMLATQATWYADYVKACLEVRKCVGVTIWDYTDKYSWIPSVFPGEGAALPYDENLAPKPAYHAIRKVLGG

SEQ ID NO: 19 - DNA, 1152 bp, Unknown
  Obtained from an environmental sample
atgaagatgttaaaaactattgttgtggctgtagcagccttactatccagtcctactgcttcagccactttacagaacctgaagcgggctcctgattcattgaccttgaaagatgcatttgagggtaagttttatataggaacagcattaaaccttgatcagatatgggagcgcgatcaggctgcggtcgcggtggtcaaaacgcagttcaactccatagttgctgagaattgtatgaaaagtatgtttttgcaaccaagggaaggtgagtttgattttagggatgcggaccgttttgtcgcgtttggagaaaaaaataaaatgcaaattatcggtcatacgctgatttggcattcgcagacaccagcttggttttttgtcgataaaaatgggaaagaggtcacccgagaggtacttatcgagcgcatgcggaagcatatacaaaccgttgtttcccgctataagggaagggtgtttggttgggatgtggtgaacgaagccatattggataatggagaatggcgtaaaagcaaattctaccagattatcgggccacaatttattgaattggccttcaaatttgcgcatgacgcagatccaaatgcagaattatattataacgattattcaactgctatccccgaaaaaagaaaggggattatgcgcatggtgcagcaggtaaaggctgccggtgggcaggtcactggaattggtatgcaggaacacaacgcattggacaatccaccggtcgatgaagtcgaaaaaaccatactcggatttgcaagccttggtgcgaaggtaatggttacggaaatggatatttcggtcctgccgcatgtacgtcccaatatgggcgcagaaataggggagcgtcatgcctacagtaaagcgatgaatccgtacgaaaaaggacttcctgtaacgaaaatgaacgagttgggagcgagatatgtagcgttttttaatttatatctcaaacatcgggataaaatatcgcgtgtgacattgtggggtgttggcgatggagattcatggaagaatggttggcctattcccggacgtacagactatccattgttattcgatcggaattaccaacccaaaccttttgtaaaagatattattgcgttgactcaaaaaaaaaagaaataa

SEQ ID NO: 20 - protein, 383 aa, Unknown
  Obtained from an environmental sample
  SIGNAL (1)...(29)
MKMLKTIVVAVAALLSSPTASATLQNLKRAPDSLTLKDAFEGKFYIGTALNLDQIWERDQAAVAVVKTQFNSIVAENCMKSMFLQPREGEFDFRDADRFVAFGEKNKMQIIGHTLIWHSQTPAWFFVDKNGKEVTREVLIERMRKHIQTVVSRYKGRVFGWDVVNEAILDNGEWRKSKFYQIIGPQFIELAFKFAHDADPNAELYYNDYSTAIPEKRKGIMRMVQQVKAAGGQVTGIGMQEHNALDNPPVDEVEKTILGFASLGAKVMVTEMDISVLPHVRPNMGAEIGERHAYSKAMNPYEKGLPVTKMNELGARYVAFFNLYLKHRDKISRVTLWGVGDGDSWKNGWPIPGRTDYPLLFDRNYQPKPFVKDIIALTQKKKK

SEQ ID NO: 21 - DNA, 1119 bp, Unknown
  Obtained from an environmental sample
atgcggattcactggctggggctcagctcacgcgcaagcctgatgacggcggcgctcctggctgtcacaggcaccaccaaatccgaggactcgcccgcaactttgaaagacgccttcaaggattgtttccggatcggggtcgcgctcaaccagcggcaatttaccgagcaagataccaacggcgcgacgttggtgaaacggcagttcaacgccatctcacccgaaaacgtgatgaagtgggcgaacattcatccccgacccgggcccgatgggtataacttcgaggcggctgaccgttacgtcgagtttggcgagaagaacggaatgttcatcgtcggccatacgctcgtttggcacttccaaacgccgcgctgggtactccagggcgatggcactaacgcggcgacgcgcgagctgctgctgcagcggatgcgcgatcacatccacacggtcgtaggccggtacaaagggcggatcaaggcttgggacgtggtcaacgaagcgctgaacgaagatggcactctgcggcggtcgcagtggtaccggatcatcggcgaagactacatcgtcaaggctttcgaatatgcgcatgaggccgatccgtccgcggaattgcgatacaacgattacgccatcgagaatgagcggaagcgcgacggcgtaatcgcgctcgtgaagaaacttcaggcgcagaaggtcccacttggggggctgggctcgcagacgcatgccaacctgacctggcctaacgccgaatcgctggacaccgccctcacggccttcaccgaactgggtatcccgatctcaatcacggaactggatgtgaccgcctcgcaacgcggtcagctcaaccagagcgccgaggtgtcgcagaatggacaggcgggggagggaggcgtggtggacggggcgaatcagaagctcgccgagcagtacgccaacttcttccgcgtctttctgaagcatcgcaaaaacattgagctcgtgacgttttggggcgtcacggatcgtgactcctggcggcgcattggcaaaccgctgctatttaacgcagaatggcaacccaagccggcctttcacgccgtcatcgccgaggcgaaaaagatcagtgggcaatga

SEQ ID NO: 22 - protein, 372 aa, Unknown
  Obtained from an environmental sample
  SIGNAL (1)...(28)
MRIHWLGLSSRASLMTAALLAVTGTTKSEDSPATLKDAFKDCFRIGVALNQRQFTEQDTNGATLVKRQFNAISPENVMKWANIHPRPGPDGYNFEAADRYVEFGEKNGMFIVGHTLVWHFQTPRWVLQGDGTNAATRELLLQRMRDHIHTVVGRYKGRIKAWDVVNEALNEDGTLRRSQWYRIIGEDYIVKAFEYAHEADPSAELRYNDYAIENERKRDGVIALVKKLQAQKVPLGGLGSQTHANLTWPNAESLDTALTAFTELGIPISITELDVTASQRGQLNQSAEVSQNGQAGEGGVVDGANQKLAEQYANFFRVFLKHRKNIELVTFWGVTDRDSWRRIGKPLLFNAEWQPKPAFHAVIAEAKKISGQ

SEQ ID NO: 23 - DNA, 1137 bp, Unknown
  Obtained from an environmental sample
atgaggacaaaacaagtttttaaattaaccacgctcgctttattattaacagcagttgttagtagctgttctgccccaaaagcggcaaaagaagatacgcttaaagatgccctccagggaaaattctttattggtgctgctgttaatgttgaccaaatggcaggaaaggattctcttgcaattgaagttgttaaaaagaactttagctcaattgtggccgagaattgcatgaaaatggaaaacatccatcctgtaaaaggtgaatttttcttcgatgaagccgatgcatatgttgaatttggcgaaaaaaacaacatgaaaatcattggtcacacattgatttggcattcacaagccgccaaatgggcatttgttgatgatgaaggcaaagatgtatcgcgcgaagaattaattgaacggatgcgcaaccacatccataccattgtaggccgctataaaggtcgtgtacatggctgggacgttgttaatgaggctattctggataacggcgaatggcgtcagagcaaatggtataccattattggacccgaatttgttcagcttgcttttgagtttgcccacgaagccgaccccaacgctgaattgtattacaacgactacaacgagtggattccggctaaaagagacggcatttacaacatggttaaggatttaatcgacaaaggcgttaaagttgatggaattggcctacagggtcacattgctcttgactctcccagcatcgaactttacgaagaagccattgtaaaatatgcaagtctgggtgtgcaaacaatggttaccgaactcgatatcactgttttaccatggccatcgcagcaagttacagccgatatatcttttagtgcagagctatcaaccgaatacaatccatttgttaatggtttacccgattcggttagcgttgaacttaccaaccgttttgccagtttcttcgagttgtttttgaaacatcaggataaaattgaccgcgttactctatggggtgtacacgatggtcaatcatggaaaaacaactggcccatcaggggacgtaaagattatccgttgttattcgacaggcaatatcagtccaaacctgccgttcagcgcataatcgaattggctaaacaataa

SEQ ID NO: 24 - protein, 378 aa, Unknown
  Obtained from an environmental sample
  SIGNAL (1)...(29)
MRTKQVFKLTTLALLLTAVVSSCSAPKAAKEDTLKDALQGKFFIGAAVNVDQMAGKDSLAIEVVKKNFSSIVAENCMKMENIHPVKGEFFFDEADAYVEFGEKNNMKIIGHTLIWHSQAAKWAFVDDEGKDVSREELIERMRNHIHTIVGRYKGRVHGWDVVNEAILDNGEWRQSKWYTIIGPEFVQLAFEFAHEADPNAELYYNDYNEWIPAKRDGIYNMVKDLIDKGVKVDGIGLQGHIALDSPSIELYEEAIVKYASLGVQTMVTELDITVLPWPSQQVTADISFSAELSTEYNPFVNGLPDSVSVELTNRFASFFELFLKHQDKIDRVTLWGVHDGQSWKNNWPIRGRKDYPLLFDRQYQSKPAVQRIIELAKQ

SEQ ID NO: 25 - DNA, 978 bp, Unknown
  Obtained from an environmental sample
gtggatccaaagaattccttacgcgccttagctcaaaagcgaggaattgggtttgggacggcagtttgggttgagcctctgtctaacgattcgagatatcggacggtgttggcgcaggagttcaatatggtgacgccagagaatgagatgaagtttgagccgacgcatccagaacgggagcgctacgattttacagcagccgatacccttgttgactttgccaagaaccataacatgcaggtgcgcggacataccctggtttggcatgaaagtctccccgattggctaacgactcaaacgtggacgcgtgaggagttgatgtccatcttagaagaacacatcaatacagttgtcgatcgctatcgggggcaattagttgcctgggatgtggtgaatgaagcgatcgccaacgataaaaacgcactcagagatacgatttggctgcgaacaatcgggccagagtatatagagaaggcatttcgctgggcgcatgcagccgaccctcaagcacgtttattttacaacgattatggcggcgaggaagtggggggaaagtctgaggccatctatggcatgcttaaagatttgctgcaacagggtgtcccgattcacggggttggcttgcaaatgcacgttagtataaaaaaccctcccaatcccgaaaaagtggcggcaaatatcaagcgcctgaacgatctgggattggaagtgcatataactgagatggatgtgaaaacctgggatggcatcggtacgaagcagcaacgacttgcggctcaggcacaagtgtatcggaacatgatgcaggtgtgtttggaagctgagaactgtaaggcgttttcgttgtggggggtaagcgatcgctattcttggattccccggatttttaagaagccggatgcaccactgatttttgatgatttagggcgtccgaaacccgcttacaatgccctgaaagaagtcctcaagcggcgttaa

SEQ ID NO: 26 - protein, 325 aa, Unknown
  Obtained from an environmental sample
VDPKNSLRALAQKRGIGFGTAVWVEPLSNDSRYRTVLAQEFNMVTPENEMKFEPTHPERERYDFTAADTLVDFAKNHNMQVRGHTLVWHESLPDWLTTQTWTREELMSILEEHINTVVDRYRGQLVAWDVVNEAIANDKNALRDTIWLRTIGPEYIEKAFRWAHAADPQARLFYNDYGGEEVGGKSEAIYGMLKDLLQQGVPIHGVGLQMHVSIKNPPNPEKVAANIKRLNDLGLEVHITEMDVKTWDGIGTKQQRLAAQAQVYRNMMQVCLEAENCKAFSLWGVSDRYSWIPRIFKKPDAPLIFDDLGRPKPAYNALKEVLKRR

SEQ ID NO: 27 - DNA, 1173 bp, Unknown
  Obtained from an environmental sample
atgaaatccttaacaaatcaatccttcatgaaactcataatctgtctggcattgccagtcgcactactcagcatttcatgcaaaaaacccgccgaaccactgaaaccggttgaaggcttaaaagacagcttcaaagacaagtttctcatgggtgtggcgctgaataaagcacagattctgggaagagatacattggtacatgcttttacagtacagcattttaattccattactgcagaaaacgaaatgaagtgggaacgcatccacccgcagcctgatgtatatgatttcacggttccggacagcctgattgcttttggcgaacgcaacggcatgtttatagtcgggcatacactcgtatggcactcccaggtgcccgattgggttttcaccgatgagaagggaaagcctctgacccgcgatgctctgctccaacgcatgaaggatcatatttatgccgttgtcggccggtataagggcaaggtggatggctgggatgtggtaaatgaagcattggatgaagacggacagctgcgcaaatccaggtggcatgaaatcatcggtgatgattacattcagaaagcctttgagttcacccgggaggcagatcccggtgcagagctttattacaatgattacaacatagaactcaaaaaaaagcgggagggtgctgtcaggctgctacaggaactgcagcaaaaaggcattaaaatcgacggagtgggcattcagggacattggcacctgcactcacctgatctgcaagagattgattcaagtcttcaggcatacggacaacttggtctgaaggtcatgatcaccgaactggatgttaacgtcattcccgaaccttcaggtattattggcgccgatgttgcacagcgggcggattatcagagccagctgaatccatggcctgaaagttttcccgattccatgcagcaggttctggccagccggtatgccgaactgttcggattgttcctgaagcacagcgataaggtaagccgggtgaccttctggggaattcacgatggctattcctggaagaacaactggccaataccgggccgaacaacttatcccctcctttttgaccggaattaccagcctaaacctgcgtatgatgctgtcattgaattgaccaaaatacagccggaagccagtaactga

SEQ ID NO: 28 - protein, 390 aa, Unknown
  Obtained from an environmental sample
  SIGNAL (1)...(27)
MKSLTNQSFMKLIICLALPVALLSISCKKPAEPLKPVEGLKDSFKDKFLMGVALNKAQILGRDTLVHAFTVQHFNSITAENEMKWERIHPQPDVYDFTVPDSLIAFGERNGMFIVGHTLVWHSQVPDWVFTDEKGKPLTRDALLQRMKDHIYAVVGRYKGKVDGWDVVNEALDEDGQLRKSRWHEIIGDDYIQKAFEFTREADPGAELYYNDYNIELKKKREGAVRLLQELQQKGIKIDGVGIQGHWHLHSPDLQEIDSSLQAYGQLGLKVMITELDVNVIPEPSGIIGADVAQRADYQSQLNPWPESFPDSMQQVLASRYAELFGLFLKHSDKVSRVTFWGIHDGYSWKNNWPIPGRTTYPLLFDRNYQPKPAYDAVIELTKIQPEASN

SEQ ID NO: 29 - DNA, 2331 bp, Archaea
atgacgatgcagagaaagtactcatccgacgcgaacacacagtatgagtggataaaatcagctactgtaccatctggtcagtgggtacagctctctggaacgtacacgatcccggccggagttaccgtggaagatctcacgctttacttcgaatctcaaaatccaacccttgagttctacgtggatgacgtgaagatagtggatacaacttccgcagagataaagattgaaatggaacctgaaaaagagatacctgctctgaaagaagtactgaaagattacttcaaagtcggagttgcactgccgtccaaggtcttcctcaacccgaaggacatagaactcatcacgaaacacttcaacagcatcaccgcagaaaacgagatgaaaccggatagtctgctcgcgggcatcgaaaacggtaagctgaagttcaggtttgaaacagcagacaaatacattcagttcgtcgaggaaaacggcatggttataagaggtcacacactggtgtggcacaaccagacacccgactggttcttcaaagacgaaaacggaaacctcctctccaaagaagcgatgacggaaagactcaaagagtacatccacaccgttgtcggacacttcaaaggaaaagtctacgcatgggacgtggtgaacgaagcggtcgatccgaaccagccggatggactgagaagatcaacctggtaccagatcatggggcctgactacatagaactcgccttcaagttcgcaagagaggcagatccagatgcaaaactcttctacaacgactacaacacattcgatcccagaaagagagacatcatctacaacctcgtgaaggatctcaaagagaagggactcatcgatggcataggaatgcagtgtcacatcagtcttgcaacagacatcaaacagatcgaagaggccatcaaaaagttcagcaccatacccggtatagaaattcacatcacagaactcgatatgagtgtctacagagattccagttccaactacccagaggcaccgaggacggcactcatcgaacaggctcacaaaatgatgcagctctttgagatcttcaagaagcacagcaacgtgatcacgaacgtcacattctggggtctcaaggacgattactcctggagagcaacaagaagaaacgactggccgctcatcttcgacaaagatcaccaggcgaaactcgcttactgggcgatagtggcacctgaggtccttccaccacttccaaaagaaagcaggatctccgaaggcgaagcagtggtagtggggatgatggacgactcgtacctgatgtcgaagccgatagagatccttgacgaagaagggaacgtgaaggcaacgatcagggcagtgtggaaagacagcacgatctacatctacggagaggtacaggacaagacaaagaaaccagcagaagacggagtggccatattcatcaacccgaacaacgaaagaacaccctatctgcagcctgatgacacctacgttgtgctgtggacgaactggaagacggaggtcaacagagaagacgtacaggtgaagaaattcgttgggcctggctttagaagatacagcttcgagatgtcgatcacgataccgggtgtggagttcaagaaagacagctacataggatttgacgttgcggtgatagacgacgggaagtggtacagctggagcgacacgacgaacagccagaagacgaacacgatgaactacggaacgctgaagctcgaaggaataatggtagcgacagcaaaatacggaacaccggtcatcgatggagagatcgatgagatctggaacacgacagaggagatagagacgaaagcggtggctatgggatcgcttgacaagaatgcgacagcgaaagtgagggtgctgtgggacgagaactacctgtacgtacttgcgatcgtgaaagagcccgttctgaacaaagacaacagcaacccgtgggagcaggattccgtggagatcttcgtggatgagaacaaccacaagacaggatactacgaagacgacgacgcgcagttcagggtgaactacatgaacgagcagacctttggaacgggaggaagtccagcgaggttcaagacagcggtgaagctgatcgaaggaggatacatagttgaggcagcgatcaagtggaagacgatcaagccaacaccgaacacagtgataggattcaacatccaggtgaacgatgcgaacgagaaagggcagagggtcggtatcatctcctggagcgatcccacaaacaacagctggcaagatccttcaaagttcggtaacctcagactcatcaagtga

SEQ ID NO: 30 - protein, 776 aa, Archaea
MTMQRKYSSDANTQYEWIKSATVPSGQWVQLSGTYTIPAGVTVEDLTLYFESQNPTLEFYVDDVKIVDTTSAEIKIEMEPEKEIPALKEVLKDYFKVGVALPSKVFLNPKDIELITKHFNSITAENEMKPDSLLAGIENGKLKFRFETADKYIQFVEENGMVIRGHTLVWHNQTPDWFFKDENGNLLSKEAMTERLKEYIHTVVGHFKGKVYAWDVVNEAVDPNQPDGLRRSTWYQIMGPDYIELAFKFAREADPDAKLFYNDYNTFDPRKRDIIYNLVKDLKEKGLIDGIGMQCHISLATDIKQIEEAIKKFSTIPGIEIHITELDMSVYRDSSSNYPEAPRTALIEQAHKMMQLFEIFKKHSNVITNVTFWGLKDDYSWRATRRNDWPLIFDKDHQAKLAYWAIVAPEVLPPLPKESRISEGEAVVVGMMDDSYLMSKPIEILDEEGNVKATIRAVWKDSTIYIYGEVQDKTKKPAEDGVAIFINPNNERTPYLQPDDTYVVLWTNWKTEVNREDVQVKKFVGPGFRRYSFEMSITIPGVEFKKDSYIGFDVAVIDDGKWYSWSDTTNSQKTNTMNYGTLKLEGIMVATAKYGTPVIDGEIDEIWNTTEEIETKAVAMGSLDKNATAKVRVLWDENYLYVLAIVKEPVLNKDNSNPWEQDSVEIFVDENNHKTGYYEDDDAQFRVNYMNEQTFGTGGSPARFKTAVKLIEGGYIVEAAIKWKTIKPTPNTVIGFNIQVNDANEKGQRVGIISWSDPTNNSWQDPSKFGNLRLIK

SEQ ID NO: 31 - DNA, 1134 bp, Unknown
  Obtained from an environmental sample
gtggaaaccgtcggagcaccggagctgagctatgaaatccggaatttccgggtggtggcaccggacggagtgccggatatacagcccacagccgcaccggaagcgcaggctgttccggaaggggagatgccttccctgaaggatgtatacgcgggcaaattcgacttcggtacggcgctgccccggaatgcattcaatgatatccagctgctgagactggtgaaggaccagttcaacatcctgacaccggaaaatgagatgaaaccggatgcaatcctggatgtgtacggcagcaaaaaactggcggaaaaggacgagacagcggtggctgtccggtttgaagcatgcaagacgctgcttcggttcgcacagtccaacggcctgaaggtgcacggccatacgctgctgtggcacaaccagaccccggaagcccttttccacgaaggttatgacaccaccaagccgatggccggccgggaagtgatgttgggccggatggagaattacatccgcgaagtgctgacctggaccgaagaaaattatccgggcgtgatcgtttcctgggacgtggtgaatgaagcaatcgacgacggaacgaaccagctgcgcaccggtgccaactggtataagacggtcggaccggactacctggcacgcgcgtttgaatatgcccggaaatacgcggcggaaggcgtgctgctgtactacaacgattacaataccgcatacggcggtaagctgtatgggattgtggatctgctggagagcctgattgccgagggcaatattgacggatacggattccagatgcaccacagcctgggagaaccttccatggatatgattacccgggcagtagagaaaatagcctcgctgggactccggctgcgtgtgagcgaactggacatcaacgccggcaaggcgacagagaaaaatttcgaagcccagaagaacaagtacaaacaggtgatgaagctgatgctccggttcaaggaccagactgaagcggtccaggtgtggggcgtgacggacatcatgagctggcgcagggacggatatccgctgctgtttgacaagaacatgaatccgaaacccgcgttcttcggtgtgatcgaagccggaatggaagactga

SEQ ID NO: 32 - protein, 377 aa, Unknown
  Obtained from an environmental sample
VETVGAPELSYEIRNFRVVAPDGVPDIQPTAAPEAQAVPEGEMPSLKDVYAGKFDFGTALPRNAFNDIQLLRLVKDQFNILTPENEMKPDAILDVYGSKKLAEKDETAVAVRFEACKTLLRFAQSNGLKVHGHTLLWHNQTPEALFHEGYDTTKPMAGREVMLGRMENYIREVLTWTEENYPGVIVSWDVVNEAIDDGTNQLRTGANWYKTVGPDYLARAFEYARKYAAEGVLLYYNDYNTAYGGKLYGIVDLLESLIAEGNIDGYGFQMHHSLGEPSMDMITRAVEKIASLGLRLRVSELDINAGKATEKNFEAQKNKYKQVMKLMLRFKDQTEAVQVWGVTDIMSWRRDGYPLLFDKNMNPKPAFFGVIEAGMED

SEQ ID NO: 33 - DNA, 1815 bp, Unknown
  Obtained from an environmental sample
atggttcgcaaaaaactattttatatcgtcgcgttaatgctgatgttcggcgcaagttttacttccgctcaggacgcggaattttccctgcgcggtttagccgagcgcaataacttttatgttggagcagccgtttataccactcatctgaatgatcctgtccatgttgaaacactggcacgagaattcaatatgctcacgcctgaacagcaggccaaacattgtgagttggaggcacagcaaggtcaatttgactttcggagtttcgatcgtttagtcgccttcgccgaagaacacaacatggcgatacacggtcatgcgctggtctggcatagctgcacaccgcaatgggtggctaacggcgagtacacccgtgacgaagccattggtctgctgcgcgactcgattatgaccattgttggccgttacaaaggccgtattccgatttgggacgtcgtcaatgaaggcattgctgacagcggcggaacactgcgcgatacgccatggcggcagttaattggcgatgattacatcgaacttgccttccagttcgctcatgaagccgacccggatgcgctgctgttttacaacgactataatacggaaggcatgaaccctaaatcggacgccatgtacgagatggtgagcgattttgtggcgcgtggaattccgattcacggggttgggctgcaatcccatttcatattaggcagttttgacccagaccagattgctcggaacgtcgcgcggcttggcgaactcggtttacaagttcaattcaccgaggtcgatattcgatattccggcgaggcgacagataatatcctccagcggcaggcgggcgattaccatcgcctgatggacgtttgcctcggtaacgacgcctgtactgcgtttatcacctggggcgtgaccgataaatatacctggttgcggggcgcgaacctgggcttctacaacaacctatcggttgaaccgctgctttttgacgatgactatgaacccaagcccgcttattttgcggtgctggactcactagcgcgaagagcgggcgaaacccccgttttgagcgatgacgagcttgcggcgatgatcggcggcacagtccaaacggtcgaaattcccccgccgacgaaaagcaatctcagtcaggaagcgccggacgccgttcctggtgtgatctattacgccgcctaccccataagcatcacagttgacggcgaagccaacgattgggaacgcattccgcgcggtatgattgacagcggccccaccgtacctcaggataacgacacgacaatgacatttgccgccgctgccgacaaaaccaatctatacttccttgcagaggttacggacagccaggtgtcctacggaacgcacgacccggctactgcctggtatcaggaggactcggttgagttttacctgaacacgacaggcgatctaactaacaccgcctaccaacccggcgtcgcccaaatcggtatcatggcagccaacatcgacaacgataatcccggtgcaccgatcatcgggggcggcaacagcgacatttcgcaggtaaaagcgattgtcgtcaaaaccgataccgggtatctggtcgaggcgtctgttccactcatgaccgatgtctggacgattgaaccgaaacaaggggctgtactcggcttccaagtgcatctcaatggctcacgcacaccggatgccgaccgagacaccaagttgatctggtcgctactggatacgctagatcagtcctatagcaatcccagcctgtttggccgactcatcttctggaacataaatctctaa

SEQ ID NO: 34 - protein, 604 aa, Unknown
  Obtained from an environmental sample
  SIGNAL (1)...(23)
MVRKKLFYIVALMLMFGASFTSAQDAEFSLRGLAERNNFYVGAAVYTTHLNDPVHVETLAREFNMLTPEQQAKHCELEAQQGQFDFRSFDRLVAFAEEHNMAIHGHALVWHSCTPQWVANGEYTRDEAIGLLRDSIMTIVGRYKGRIPIWDVVNEGIADSGGTLRDTPWRQLIGDDYIELAFQFAHEADPDALLFYNDYNTEGMNPKSDAMYEMVSDFVARGIPIHGVGLQSHFILGSFDPDQIARNVARLGELGLQVQFTEVDIRYSGEATDNILQRQAGDYHRLMDVCLGNDACTAFITWGVTDKYTWLRGANLGFYNNLSVEPLLFDDDYEPKPAYFAVLDSLARRAGETPVLSDDELAAMIGGTVQTVEIPPPTKSNLSQEAPDAVPGVIYYAAYPISITVDGEANDWERIPRGMIDSGPTVPQDNDTTMTFAAAADKTNLYFLAEVTDSQVSYGTHDPATAWYQEDSVEFYLNTTGDLTNTAYQPGVAQIGIMAANIDNDNPGAPIIGGGNSDISQVKAIVVKTDTGYLVEASVPLMTDVWTIEPKQGAVLGFQVHLNGSRTPDADRDTKLIWSLLDTLDQSYSNPSLFGRLIFWNINL

SEQ ID NO: 35 - DNA, 2286 bp, Unknown
  Obtained from an environmental sample
atgaccttgattacgccaagctcgaaattaaccctcactaaagggaacaaaagctggagctcgcgcgcctgcaggtcgacactagtggatctcacgctttacttcgaatctcaaaatccaacccttgagttctacgtggatgacgtgaagatagtggatacaacttccgcagagataaagattgaaatggaacctgaaaaagagatacctgctctgaaagaagtactgaaagattacttcaaagtcggagttgcactgccgtccaaggtcttcctcaacccgaaggacatagaactcatcacgaaacacttcaacagcatcaccgcagaaaacgagatgaaaccggatagtctgctcgcgggcatcgaaaacggtaagctgaagttcaggtttgaaacagcagacaaatacattcagttcgtcgaggaaaacggcatggttataagaggtcacacactggtgtggcacaaccagacacccgactggttcttcaaagacgaaaacggaaacctcctctccaaagaagcgatgacggaaagactcaaagagtacatccacaccgttgtcggacacttcaaaggaaaagtctacgcatgggacgtggtgaacgaagcggtcgatccgaaccagccggatggactgagaagatcaacctggtaccagatcatggggcctgactacatagaactcgccttcaagttcgcaagagaggcagatccagatgcaaaactcttctacaacgactacaacacattcgatcccagaaagagagacatcatctacaacctcgtgaaggatctcaaagagaagggactcatcgatggcataggaatgcagtgtcacatcagtcttgcaacagacatcaaacagatcgaagaggccatcaaaaagttcagcaccatacccggtatagaaattcacatcacagaactcgatatgagtgtctacagagattccagttccaactacccagaggcaccgaggacggcactcatcgaacaggctcacaaaatgatgcagctctttgagatcttcaagaagcacagcaacgtgatcacgaacgtcacattctggggtctcaaggacgattactcctggagagcaacaagaagaaacgactggccgctcatcttcgacaaagatcaccaggcgaaactcgcttactgggcgatagtggcacctgaggtccttccaccacttccaaaagaaagcaggatctccgaaggcgaagcagtggtagtggggatgatggacgactcgtacctgatgtcgaagccgatagagatccttgacgaagaagggaacgtgaaggcaacgatcagggcagtgtggaaagacagcacgatctacatctacggagaggtacaggacaagacaaagaaaccagcagaagacggagtggccatattcatcaacccgaacaacgaaagaacaccctatctgcagcctgatgacacctacgttgtgctgtggacgaactggaagacggaggtcaacagagaagacgtacaggtgaagaaattcgttgggcctggctttagaagatacagcttcgagatgtcgatcacgataccgggtgtggagttcaagaaagacagctacataggatttgacgttgcggtgatagacgacgggaagtggtacagctggagcgacacgacgaacagccagaagacgaacacgatgaactacggaacgctgaagctcgaaggaataatggtagcgacagcaaaatacggaacaccggtcatcgatggagagatcgatgagatctggaacacgacagaggagatagagacgaaagcggtggctatgggatcgcttgacaagaatgcgacagcgaaagtgagggtgctgtgggacgagaactacctgtacgtacttgcgatcgtgaaagatcccgttctgaacaaagacaacagcaacccgtgggagcaggattccgtggagatcttcgtggatgagaacaaccacaagacaggatactacgaagacgacgacgcgcagttcagggtgaactacatgaacgagcagacctttggaacgggaggaagtccagcgaggttcaagacagcggtgaagctgatcgaaggaggatacatagttgaggcagcgatcaagtggaagacgatcaagccaacaccgaacacagtgataggattcaacatccaggtgaacgatgcgaacgagaaagggcagagggtcggtatcatctcctggagcgatcccacaaacaacagctggcaagatccttcaaagttcggtaacctcagactcatcaagtga

SEQ ID NO: 36 - protein, 761 aa, Unknown
  Obtained from an environmental sample
MTLITPSSKLTLTKGNKSWSSRACRSTLVDLTLYFESQNPTLEFYVDDVKIVDTTSAEIKIEMEPEKEIPALKEVLKDYFKVGVALPSKVFLNPKDIELITKHFNSITAENEMKPDSLLAGIENGKLKFRFETADKYIQFVEENGMVIRGHTLVWHNQTPDWFFKDENGNLLSKEAMTERLKEYIHTVVGHFKGKVYAWDVVNEAVDPNQPDGLRRSTWYQIMGPDYIELAFKFAREADPDAKLFYNDYNTFDPRKRDIIYNLVKDLKEKGLIDGIGMQCHISLATDIKQIEEAIKKFSTIPGIEIHITELDMSVYRDSSSNYPEAPRTALIEQAHKMMQLFEIFKKHSNVITNVTFWGLKDDYSWRATRRNDWPLIFDKDHQAKLAYWAIVAPEVLPPLPKESRISEGEAVVVGMMDDSYLMSKPIEILDEEGNVKATIRAVWKDSTIYIYGEVQDKTKKPAEDGVAIFINPNNERTPYLQPDDTYVVLWTNWKTEVNREDVQVKKFVGPGFRRYSFEMSITIPGVEFKKDSYIGFDVAVIDDGKWYSWSDTTNSQKTNTMNYGTLKLEGIMVATAKYGTPVIDGEIDEIWNTTEEIETKAVAMGSLDKNATAKVRVLWDENYLYVLAIVKDPVLNKDNSNPWEQDSVEIFVDENNHKTGYYEDDDAQFRVNYMNEQTFGTGGSPARFKTAVKLIEGGYIVEAAIKWKTIKPTPNTVIGFNIQVNDANEKGQRVGIISWSDPTNNSWQDPSKFGNLRLIK

SEQ ID NO: 37 - DNA, 2769 bp, Unknown
  Obtained from an environmental sample
atgcacaagaagaacggcacctattacctgagctactctacaaatccggccaacggcatgcggattgactacatgaccagcacgagcccgaccagtggctttgtccatcgaggcacggtcatggcgcagccctggcagaacagcaacaacaacaaccacgcaaccagcaccgagtacaacgggcagggctacatcttctatcacaaccgtgcgttgtcgaacgagcgtgcgggtggcaacgtgctgcagcgctcggtgaacgtggatcgcctctacttcaatgccgatggcagcatccgtcaggtcacttccagtgcaaccggcgtgccggccctgaaaaccctggatgccttcctggtcaagcctgccgagctgtatcacaaggaaagcgggatcaagaccgagcctgccagtgaaggaacccaggcactggttatgacggctggtagctgggtgcgcctggccaatgtcgatttcggcaatggcggcgccactggtttttccgcgcgtattgcggcaaccggcagcggcagcatccaggtgatcctgggcaatctgaacaacgccccggtcggcacgctggcagtgagcagcaccggcaacctccagacctggcaagaccgcagcaccgccatcagcaaggtgaccggcgtgcatgacgtgtatttgcgtgccaccggcaatgtgcatgtgcagcgtcactggttcgtggcgtcggcgccggccgctgccgcctcatccagcagtcaggcaagcgtctctgccagcagtcaggcaagtgtttcttccagtagccaggcaagcgttgcctccagcagcagttccagccgcgcttcttccgccagcagttcggtggcggctggccaggtggaggtcggttatcgccttagcagcgaatgggccgccggcttctgcggcgtggtcaccatccgtaatccgggtagttctccggtcaccagctggagtggcagtttcaacctgcctggcggcaagatcacccagctgtggaatgccaactggacccagaacggcagcaccgtgacggtatcttcccaggcctggagcggtgccattgctgcaggcgccaccatcaccacgccgggcttctgcgccgagcgcacgagcagcaatgcgtcctccagtgtcgccagcagcagtgtctcctcatcgagcagcagtgctgcggctgccagctccagcgcggcttccagcgtcccgtccactggcagtggcggggtgggcagcagcgcatcctcggctagcagtgccgctgcacccaagggcgtgcttgaagtcggcctgagcggcctttccagccaggccatgttcgccccgttgcgggtcaggacggacgctgcggccgccaacaaggcctatgttgaatggcccaacaacggcgccaatcagtcgctggcaacgcctgccaacgatgccgcagggcaggtggaggtagccttcgtgctggcccaggcatccgcagtgcagtttgatatcgaagcgaatttcgccaacgcggaagacgactccttctacttccagctcaacggtggtgcctggcagaccttcaacaacgccaccacggtcggctggcagaccctgccggtcgcctctctgggcaatctggctgccgggcgccatgtgctgaccctgctgcgccgcgaggatggcgcgaagctgggcaaggtcgtcctgagtgcggcacagagcagcatcagtcgtgccacgccggtggcctacgcgtcgccgaatgatgttgccaacctgttcaagctggccagcttcccgatcggggtggcggtcagtgccggcaacgaaggtgacagcctgctgcgtagcggtacccgcgcagcagccgagcgtgcgctgaccgagaagcacttcaacagtctggtggccggcaacatcatgaagatgagctacctgcatccggccgagaacacctacaccttcacccaggcggatgcgctggccgactacgccaagtccaagggcatggtgttgcatggccatgcgctggtctggcatgcggactatcaggtacccaactggatgaagaattacaccggagactggtcgaagatgctcgaagcccacgtcaccaccgtcgccaagcactatgccggcaaggtggtgagctgggatgtggtgaatgaagccctggccgatggcaatgccaccgccaccaagggtttccgtgccaccgattcgatcttctatcagaagatgggctccagtttcatcgagaaggcctttattgctgcacgtgctgccgacccgaatgccgacctgtattacaacgactacggcatggagggcggaaacagcaagttcaattactgcatggccatggtcgatgatttccagaagcgtggcattcccatcgacggcatcggtttccagatgcacatcaacatcgactggccttcgtcggcccagatccgcgctgtattcagtgaagtggtcaagcgtggtctgaaggtgcgtatctccgagctggatattccggtgaataccactgccggtcgttttgccagcctgaatgccacggccaacgagctgcagaagaagaagtatcgtgaggttgtggctgcctacctggatgtggtgccgcccgagctgcgcggtggcatcaccgtgtggggcctgagcgacaacggcagctggctggtgacccccaccaagccggactggccgctgctgttcgatgccgacctcaaggccaaggacgccctgagcggctttgccgacgccctgcgcggcgtacgctga

SEQ ID NO: 38 - protein, 922 aa, Unknown
  Obtained from an environmental sample
MHKKNGTYYLSYSTNPANGMRIDYMTSTSPTSGFVHRGTVMAQPWQNSNNNNHATSTEYNGQGYIFYHNRALSNERAGGNVLQRSVNVDRLYFNADGSIRQVTSSATGVPALKTLDAFLVKPAELYHKESGIKTEPASEGTQALVMTAGSWVRLANVDFGNGGATGFSARIAATGSGSIQVILGNLNNAPVGTLAVSSTGNLQTWQDRSTAISKVTGVHDVYLRATGNVHVQRHWFVASAPAAAASSSSQASVSASSQASVSSSSQASVASSSSSSRASSASSSVAAGQVEVGYRLSSEWAAGFCGVVTIRNPGSSPVTSWSGSFNLPGGKITQLWNANWTQNGSTVTVSSQAWSGAIAAGATITTPGFCAERTSSNASSSVASSSVSSSSSSAAAASSSAASSVPSTGSGGVGSSASSASSAAAPKGVLEVGLSGLSSQAMFAPLRVRTDAAAANKAYVEWPNNGANQSLATPANDAAGQVEVAFVLAQASAVQFDIEANFANAEDDSFYFQLNGGAWQTFNNATTVGWQTLPVASLGNLAAGRHVLTLLRREDGAKLGKVVLSAAQSSISRATPVAYASPNDVANLFKLASFPIGVAVSAGNEGDSLLRSGTRAAAERALTEKHFNSLVAGNIMKMSYLHPAENTYTFTQADALADYAKSKGMVLHGHALVWHADYQVPNWMKNYTGDWSKMLEAHVTTVAKHYAGKVVSWDVVNEALADGNATATKGFRATDSIFYQKMGSSFIEKAFIAARAADPNADLYYNDYGMEGGNSKFNYCMAMVDDFQKRGIPIDGIGFQMHINIDWPSSAQIRAVFSEVVKRGLKVRISELDIPVNTTAGRFASLNATANELQKKKYREVVAAYLDVVPPELRGGITVWGLSDNGSWLVTPTKPDWPLLFDADLKAKDALSGFADALRGVR

SEQ ID NO: 39 - DNA, 1143 bp, Unknown
  Obtained from an environmental sample
atgaaaaaaacgattgcacatttcaccttatggatagtgttttttctcttcacttcctgtgctgttacggcgcagaagaatgcaaagaatacaagagtaaaacccactaccctaaaagaggcttaccaaggtaaattctatatcggtactgcgatgaacttgagacagattcacggagatgatccccaatctgaaaatattatcaaaaaacagttcaattccatagttgccgaaaactgcatgaagagtatgtatcttcagccggaggaaggaaaatttttcttcgatgatgcggacaagtttgtggattttggtcttcagaacaatatgttcatcattgggcattgtctgatttggcattcgcaggcgccaaaatggtttttcaccgatgagaatggaaacacggtttctccagaagttcttaaacaaaggatgaaagcccatattaccgccgtcgtttcccgttacaaagggaaaatcaaaggttgggatgtggtgaacgaagccattatggaagatggttcttaccgtaaaagcaaattttacgagattttgggagaagaatttattccgttggcatttcagtatgcgcatgaagcagatcctgatgcagaactttattacaacgattataacgaatggtatcccggaaaaagagctacggtgaccaagataatccgcgatttcaaaactagaggaatccgcatcgatgccatcggaatgcaggctcatttcgggatggattcgcccactgtagaagagtatgaacaaactattcagggctatataaaagaaggcgtgaaagtcaatattacggaactcgatttgagtccacttccttctccttggggaacttccgccaatgttgccgatacgcagcaatatcaggaaaaaatgaatccatacaccaaaggacttcctgcagatgttgaaaaagcatgggaaaaccgttatgtggattttttcaaactgttcctaaaatatcatcagcatattgagcgtgttacgttttggggcgttagcgatatcgattcctggaagaacgattttccggtaagaggacgtaccgattatccactaccgtttaaccgtcaatatcaagcaaaacctttggttcagaaattaatagatttaacaaaatag

SEQ ID NO: 40 - protein, 380 aa, Unknown
  Obtained from an environmental sample
  SIGNAL (1)...(24)
MKKTIAHFTLWIVFFLFTSCAVTAQKNAKNTRVKPTTLKEAYQGKFYIGTAMNLRQIHGDDPQSENIIKKQFNSIVAENCMKSMYLQPEEGKFFFDDADKFVDFGLQNNMFIIGHCLIWHSQAPKWFFTDENGNTVSPEVLKQRMKAHITAVVSRYKGKIKGWDVVNEAIMEDGSYRKSKFYEILGEEFIPLAFQYAHEADPDAELYYNDYNEWYPGKRATVTKIIRDFKTRGIRIDAIGMQAHFGMDSPTVEEYEQTIQGYIKEGVKVNITELDLSPLPSPWGTSANVADTQQYQEKMNPYTKGLPADVEKAWENRYVDFFKLFLKYHQHIERVTFWGVSDIDSWKNDFPVRGRTDYPLPFNRQYQAKPLVQKLIDLTK

SEQ ID NO: 41 - DNA, 1893 bp, Unknown
  Obtained from an environmental sample
atgatccatcaacaaaagcccaaccaagacatcggtaggctattcaagcgcagctgcagctttgtcggtattagcgcggcactggctgttttctcacacaccgcaagtgcagcctgtacttacaacattgataaccaatggggcagcggttttgtcgctagtattactgtaaagaatgacactggtgcaaccgtcaataactggagtgtgaattggcaatatgccaacaatcgcatcaccaatggttggagtgcaaatttctctggcagcaatccttacaccgccaccaatatgagctggaacggtagcattgccgctggccagtcggtgacttttggtttccagggcaacactaacagcaataccgttgagcgcccggtggttaacggttcactgtgcggtactgcaacaacctcttcagttcgctccagcgtggctgcgacgtcttccagtcgctccagtgttgcgcccagctcgattcctgcttccagcactccgcgttcaagcacacctgccacctcttcttctgcttccagcttctcagtaccggccaataattttgcgcagaatggcggcgtggaatctggtttgaccaactggggtacgactgcgggcaccgtgactcgctctactgccgataaacacagcggtacagccagtgccttaattaccggccgcactgctgcctggaatggtttgacgtttaatgtgggcgcattgaccaacggcaaccagtaccaagtcaacgtgtgggtgaaattggctccaggtacgcccgacagcgtactgaccttaaccggtaagcgtgtagacgatagcgatactactacctacaacgaatacacacgcgtagcgactgtgactgcctctgccaatgagtggcgtttgctggaaggttactacacccaatctggcagcactgcattccagcatttcattatcgaagcaacggatactactgccagttattacgcggatgatttcgccatcggcggtcaagtcgtacaagttccaagcagcagctcacgcagctcaagcagtgctccggcggctagaaaattcatcggcaacatcaccacctcgggtgcagtgagatccgactttactcgttactggaaccaaattacaccagagaacgaaggtaagtggggttccgttgaaggtactcgcaaccagtacaactgggcaccgctggatcgtatttatgcttacgctcgccaaaataatattccggtaaaagctcacacgtttgtgtggggtgcgcaatcacccgcgtggctcaataacttaagcggaccggaagtcgctgttgaaattgaacaatggattcgcgattactgtactcgttaccctgacacggcgatgattgacgtagtgaacgaagcggttcctggccatcaaccggcaggttatgcacaacgagcatttggcaataactggatccaacgcgtgttccaattggctcgccaatattgccctaactcgatcctgatcctgaatgattacaacaatatccgttggcagcacaatgagtttattgcccttgcaaaagctcaaggcaattatattgatgcagtcggcctgcaggcgcatgaactgaagggtatgacagcggcgcaagtcaaaaccgcaatcgacaatatttggaaccaagtgggcaagcccatctacatttctgaatacgacattggcgataacaatgaccaggttcaattgcagaatttccaggcgcatttccctgtattctgggaccatccgcatgttaaaggcatcaccatttggggttatgtcaatggcagaacttggattgaaggctcgggcctgatttctgacaacggaacaccgcgccccgcaatgacttggttgctgaataactatatcaataagcagtaa

SEQ ID NO: 42 - protein, 630 aa, Unknown
  Obtained from an environmental sample
  SIGNAL (1)...(37)
MIHQQKPNQDIGRLFKRSCSFVGISAALAVFSHTASAACTYNIDNQWGSGFVASITVKNDTGATVNNWSVNWQYANNRITNGWSANFSGSNPYTATNMSWNGSIAAGQSVTFGFQGNTNSNTVERPVVNGSLCGTATTSSVRSSVAATSSSRSSVAPSSIPASSTPRSSTPATSSSASSFSVPANNFAQNGGVESGLTNWGTTAGTVTRSTADKHSGTASALITGRTAAWNGLTFNVGALTNGNQYQVNVWVKLAPGTPDSVLTLTGKRVDDSDTTTYNEYTRVATVTASANEWRLLEGYYTQSGSTAFQHFIIEATDTTASYYADDFAIGGQVVQVPSSSSRSSSSAPAARKFIGNITTSGAVRSDFTRYWNQITPENEGKWGSVEGTRNQYNWAPLDRIYAYARQNNIPVKAHTFVWGAQSPAWLNNLSGPEVAVEIEQWIRDYCTRYPDTAMIDVVNEAVPGHQPAGYAQRAFGNNWIQRVFQLARQYCPNSILILNDYNNIRWQHNEFIALAKAQGNYIDAVGLQAHELKGMTAAQVKTAIDNIWNQVGKPIYISEYDIGDNNDQVQLQNFQAHFPVFWDHPHVKGITIWGYVNGRTWIEGSGLISDNGTPRPAMTWLLNNYINKQ

SEQ ID NO: 43 - DNA, 1011 bp, Unknown
  Obtained from an environmental sample
atgcaaacaaatattaaaggaaataacattccatcattacacgaagtttatcaagatcactttttgataggtgcagcagttaatccaaaaacattagactcacagcaggatttattgagaaaacactttaacagtattacagctgaaaatgaaatgaaatttgaagaattgcaaccagaacctggccatttcacgtttggtgtagcagatgaaatcgtttcatttgcaaaagaaaatggaatgaaagttagaggacatacattagtttggcataatcaaacgcctgattggatgtttttgaatgaagatggatctgtcacagatcgagaaacgcttctagaaagaatgaaattacacattacaacagttatgcagcattacaaaggtcaagcttattgctgggatgttgtaaatgaggtgattgctgacgagggtacagagttattccgtaaatctaaatggactgaaattattggtgatgattttgtagaaaaggcatttgaatatgcacatgaggctgatccagaagctttactattctacaatgactataatgaatcccatcccaataagcgtgagaaaattttcacacttgtaaaaggattagttgataaggggatacctattcatggaatcggtttacaagcacattggaatttaacaggaccttcttatgaagatattagagcagcactcgagaaatatgctacattgggattggaaatacaccttaccgaattggatgtttctgtttttaattatgaagatcgaagaacagatttaacagaaccaactaaagatatgcaagcgcttcaagcggagcgttatacagaattattcaagatattgagagaatatagtcatgtaatcagttcgattactttttggggagctgcagatgattatacttggttagatgattttcctgtcaaaggaagaaaaaactggccatttgtttttgatgaaaaccaagagccaaaagagtcattttggaatattattgacttttaa

SEQ ID NO: 44 - protein, 336 aa, Unknown
  Obtained from an environmental sample
MQTNIKGNNIPSLHEVYQDHFLIGAAVNPKTLDSQQDLLRKHFNSITAENEMKFEELQPEPGHFTFGVADEIVSFAKENGMKVRGHTLVWHNQTPDWMFLNEDGSVTDRETLLERMKLHITTVMQHYKGQAYCWDVVNEVIADEGTELFRKSKWTEIIGDDFVEKAFEYAHEADPEALLFYNDYNESHPNKREKIFTLVKGLVDKGIPIHGIGLQAHWNLTGPSYEDIRAALEKYATLGLEIHLTELDVSVFNYEDRRTDLTEPTKDMQALQAERYTELFKILREYSHVISSITFWGAADDYTWLDDFPVKGRKNWPFVFDENQEPKESFWNIIDF

SEQ ID NO: 45 - DNA, 1137 bp, Unknown
  Obtained from an environmental sample
atgaagatatcacgccgacaattacttgctatgggtggtgccgctgcaaccctggcctctgccaaattattcgctgccgaaaaagctgctgccgccaccggattgaaagatgcctataaaaacgatttcctgatcggtgctgcattaaatacccaaattgttgatggcaaagaccccaaacttactgcactgatcaccaaagaatttaattcaattaccgcagagaattgccagaagtgggaaaggttgcgcaatgaaaaagatggtagctgggaatggaaagatagcgatgcctttgtgaatttcggggttgcccataacatgcatattgtcgggcatacgttgggctggcatagccaaattcccgacagcgtctttaaaaacaaagatggcagttatatttccaaagaggcactggcaaaaaaacaacaagagcacatcaccaccttagtggatcgttacaaaggcaaaattgccgcatgggatgtggttaacgaagccatgggcgatgacaacaagatgcgcgcaagccattggtacaacattatgggtgatgactttctcgtcaacgcctttaagctcgcgcatgagactgaccccaaagcacatttgatgtacaacgattacaacaacgagcgcccggaaaagcgcgcagcaacggttgatatgctcaagcgcctgttaaaactcggggcgccgatccacggtttgggaatgcaggcacatattggcctggatgcggatatgaaaaactttgaagacagtattgtcgcctattcagaattaggcttgcgtattcaccttaccgaactggatatagatgtgttgccctcggtgtggaatttgccagtcgctgaagtatctacccgttttgaatacaaaccggagcgagatccttacatcaaaggcctgccaaaagagatcgacgaaaaactcgcgaaggcttatgaatcgctatttaaaattttgcttaagcataaagacaaagtagatcgtgtgaccttctggggtgtgagtgatgatgccagctggctaaatggcttcccgatcccgggccgcaccaattatccactgttatttgaccgtaagcagcaacctaaagcagcgtacttccgcttactggatttaaagcgttaa

SEQ ID NO: 46 - protein, 378 aa, Unknown
  Obtained from an environmental sample
  SIGNAL (1)...(25)
MKISRRQLLAMGGAAATLASAKLFAAEKAAAATGLKDAYKNDFLIGAALNTQIVDGKDPKLTALITKEFNSITAENCQKWERLRNEKDGSWEWKDSDAFVNFGVAHNMHIVGHTLGWHSQIPDSVFKNKDGSYISKEALAKKQQEHITTLVDRYKGKIAAWDVVNEAMGDDNKMRASHWYNIMGDDFLVNAFKLAHETDPKAHLMYNDYNNERPEKRAATVDMLKRLLKLGAPIHGLGMQAHIGLDADMKNFEDSIVAYSELGLRIHLTELDIDVLPSVWNLPVAEVSTRFEYKPERDPYIKGLPKEIDEKLAKAYESLFKILLKHKDKVDRVTFWGVSDDASWLNGFPIPGRTNYPLLFDRKQQPKAAYFRLLDLKR

SEQ ID NO: 47 - DNA, 1137 bp, Unknown
  Obtained from an environmental sample
atgaaaagaataaagattctgaattcgattgtattagctttaatcctggcgatcatcctgccgggatgttccaatgcacagaagagcgagccggtgctgaaagatgccctttcgggaaaattttacatcggggctgctctcaataccccccaaattacgggccgggataccttgtccatgaaaatggtcaccagacattttaactccatcgtagctgagaactgcatgaaaagcggggagatccagcggaccgaaggggagtttgatttcagtcttgccgaccagtttgtcgcgttcggcgaaaaacacaacatgcacattgtggggcataccctgatatggcattcacaggcgccgcgctggtttttcaccggtgcagacggaaacgaagtcagccgggaggtactgattgagcgcatgaagaaccatatttatacggtcgtggggcgttacaaaggccgtgtccacggctgggatgtggtcaacgaagccattgaagacaacggctcatggcgcaacagcaagttttaccagatcttaggtgacgagtttgtggaactggcctttaaatttgccgcagaagccgacccggatgccgaactttactataacgactactccatggcattagaaggcaggagaaatggcgttatcagaatggtgaagaaccttcagtccaagggactcaaaattgacggtatcggcatgcaggggcatctgctcatggactcgcccacgctggaagcttatgaagaaagtatcctggcctattccggactgggcgttaaggtgatgatcacggaactcgatttgtctgcgctgccatggccagcccgtcagcagggagccgatattgccctgagggctgagtatgaggcacggatgaatccttacaccgaaggtttaaccgattcagcttccgtggcatggaatcagcggatgggcgatttcttctctcttttcctgaagcaccaggacaaaatcagcagggttaccctttggggggtcaccgataaccaatcctggaaaaataactttccgatgagaggaaggacagactacccgttgctttttgaccggaattaccaacccaaaccggtggtggaaagaatcatcaaagaagcgaaagcaaaataa

SEQ ID NO: 48 - protein, 378 aa, Unknown
  Obtained from an environmental sample
  SIGNAL (1)...(26)
MKRIKILNSIVLALILAIILPGCSNAQKSEPVLKDALSGKFYIGAALNTPQITGRDTLSMKMVTRHFNSIVAENCMKSGEIQRTEGEFDFSLADQFVAFGEKHNMHIVGHTLIWHSQAPRWFFTGADGNEVSREVLIERMKNHIYTVVGRYKGRVHGWDVVNEAIEDNGSWRNSKFYQILGDEFVELAFKFAAEADPDAELYYNDYSMALEGRRNGVIRMVKNLQSKGLKIDGIGMQGHLLMDSPTLEAYEESILAYSGLGVKVMITELDLSALPWPARQQGADIALRAEYEARMNPYTEGLTDSASVAWNQRMGDFFSLFLKHQDKISRVTLWGVTDNQSWKNNFPMRGRTDYPLLFDRNYQPKPVVERIIKEAKAK

SEQ ID NO: 49 - DNA, 996 bp, Unknown
  Obtained from an environmental sample
atgaacagctccctcccctccctccgcgatgtattcgcgaatgatttccgcatcggggcggcggtcaatcctgtgacgatcgagatgcaaaaacagttgttgatcgatcatgtcaacagtattacggcagagaaccatatgaagtttgagcatcttcagccggaagaagggaaatttacctttcaggaagcggatcggattgtggattttgcttgttcgcaccgaatggcggttcgagggcacacacttgtatggcacaaccagactccggattgggtgtttcaagatggtcaaggccatttcgtcagtcgggatgtgttgcttgagcggatgaaatgtcacatttcaactgttgtacggcgatacaagggaaaaatatattgttgggatgtcatcaacgaagcggtagccgacgaaggagacgaattgttgaggccgtcgaagtggcgacaaatcatcggggacgattttatggaacaagcatttctctacgcttatgaagctgacccagatgcactgcttttttacaatgactataatgaatgttttccggaaaagagagaaaaaatttttgcacttgtcaaatcgctgcgtgataaaggcattccgattcatggcatcggcatgcaggcgcactggagcctgacccgcccgtcgcttgatgaaattcgtgcggcgattgaacggtatgcgtcccttggtgttgttcttcatattacggaactcgatgtatccatgtttgaatttcacgatcgtcgaaccgatttggctgtcccgacgaacgaaatgatcgaacagcaagcagaacggtatgggcaaatttttgctttgtttaaggagtatcgcgatgttattcaaagtgtcacattttggggaattgctgatgaccatacatggctcgataactttccagtgcacgggagaaaaaactggccgcttttgttcgatgaacagcataaaccgaaaccagctttttggcgggcagtgagtgtctga

SEQ ID NO: 50 - protein, 331 aa, Unknown
  Obtained from an environmental sample
MNSSLPSLRDVFANDFRIGAAVNPVTIEMQKQLLIDHVNSITAENHMKFEHLQPEEGKFTFQEADRIVDFACSHRMAVRGHTLVWHNQTPDWVFQDGQGHFVSRDVLLERMKCHISTVVRRYKGKIYCWDVINEAVADEGDELLRPSKWRQIIGDDFMEQAFLYAYEADPDALLFYNDYNECFPEKREKIFALVKSLRDKGIPIHGIGMQAHWSLTRPSLDEIRAAIERYASLGVVLHITELDVSMFEFHDRRTDLAVPTNEMIEQQAERYGQIFALFKEYRDVIQSVTFWGIADDHTWLDNFPVHGRKNWPLLFDEQHKPKPAFWRAVSV

SEQ ID NO: 51 - DNA, 3162 bp, Unknown
  Obtained from an environmental sample
atgagagggaaaagcaaaaagggatttctgaacatctcagaagctgtacttgttggaattttagcaggctttcttggagttcttctcgcagctacgggggttttgagttttggtggaacagcgtcttcgtctcttgaaacggtgttcaccttgagtttcgagggaacaacgcaaggtgtcaatccctttggaaaagaagtagttctcacagcttctcaagatgtagcagccgatggcgaatattcattgaaagtagagaatagaacttccggctgggatggagttgagatcgatttaacggaaaaagtagaagcgaacaaagattatctgttgtctttctacgtctatcaaacatctgactcaccccaactttttgaagtccttgcaagaacagaagacgggaaaggtgaaaaatacgaaacccttaccgacaaggtggtagtatcgaactactggaaagaaattcttgtgcccttttccccgagtttcgagagtaccccaacaaaatgttctttgatcgttgtttcaccaaagaacccatcattcactttctatattgacaaggttcaaattctcaaaccgaagaagcaaggtccacaagtcatttacgaaacatcctttgagagtgggacgggaagctggcaagccagagggtctgatgtgaaaatcaaagtgacatcgaaagttgctcattctggaaaaaggtctctctatgtctccaacagacaaaaaggctggcatggtgtacaacttgacgtgaagagactcttgagacccgggaaaacgtatgcttttgaaggatgggtttatcaagactctggacaggatcaaacaattattctgacgatgcagagaagatattcttctgattctagcacacaatatgagtggatcaaggcggtaactgttccatcaggacaatggacgcagatctctggaacttacacaatccaaccaagagtaagcgtggaggaactcattgtttactttgaagccaaggatcccactcttgccttctatgtggacgatttcaaaataacggataccacaactactgacatcaagctcgagctgaagcctgaagaagaaattccagctcttaaagaagtgcttggagattacttcaaagtaggtgttgccttacctttcaaagtttttgccaaaccagaggatattgctctcattactaaacatttcaacagcatcactgccgaaaacgaaatgaaacctgagagtctcttggctggcgtagaaaatggaaagttgaagttcaggtttgagacagcagacaaatacgtagaatttgcacagcaaaacggtatggttgtgagaggtcacactctggtgtggcacaatcaaacaccggactggttcttcaaggacgagaacggaaatctgctctccaaagaagcaatgactgaaaggcttagggaatacatccacacagtcgtcggacacttcaaaggcaaagtttacgcgtgggacgtcgttaatgaggcagtagatccatcccaaccagatggacttagaagatctatatggtacgaaatcatgggacctgactatatagaacttgcattcaagtttgcaagagaagcggaccccaatgcaaagctcttctacaacgactacaacacctaccaggagaagaagagagacatcatttacaacctcgtcaaatccctcaaagagaagggactcattgacggtatcggtatgcagtgtcatatcggtgttgggaccagtgtcaaagagattgaagaggcaatcaaaaaattcagcaccattccaggtatcgaaattcatatcacggaactagatataagtgtgtacgaggatgcgacttccaattatccaacacctccaagggaggctctcattaaacaagcacacgtaatgagagaactctttgccatcttcaaaaagtacagcaacgtcataacaaacgttactttctggggattgaaagatgattattcctggaagaatgcccgcagaaacgactggccgctactttttgataaagactaccaagccaaacttgcctactgggccatagtcagtcctgaggctctaccggtgcttccaaagaaatggtctatcgctacaggtagtgctttggtagttggaatgatggatgactcctatttggcttcttcacctatcaaaattctcgtcgatggccaagaaaaactcacagccagagtcatctgggaagaaaacaaactcttcgtctacgcagaggtctatgacaggacaagagacaaaggaaaggacggtatcaccatctttgtggatcctaaaaacttcaaggcaccttacttgcatgaagatgctttctacgttaccataaaaaccgactggagtgttgagaagagtcgtgatgacatagaagtccagagattcgtaggtccaagtggagtaaggtacaacgttgaatgtgaaataacacttcctgaaaaactccaggaaggacagcaaatcggatttgatatcgccgtccaggatggcgataaggtctacagctggtctgatacatccaatcagcagaagctcgcaaccatgaactacggaactctcactctgcagggtgcggtaatggccacagctaagtatggcacacctgtgatcgatggtgaaatagatgacatctggtacaccactgaagaaatctcaaccgatgttgttgtcatgggttcactcaagaacgcaagggcaaaagtgagagtgctctgggatgaagagcacctctatgtgcttgccatcgtaaccgatcctgtgctcaataaggacaacaccaatccatgggaacaagactctgtagaaatcttcatagacgaaaacaacgccaaaacaccgtactatcaggacgatgatgctcaatatcgtgtcaactacctcaacgaacaatccttcggtacaggtgcaagcagcaagaacttcaagacagccgtgaaactcatcgatggtggttatcttgttgaggcagcggttaaatggaagaccatcaaaccttcaccaaacacagtgataggctttgatttccaggtgaacgatgcaaatgctcaaggtaagagagttggaatacttaagtggtgcgatccaacggacaacagctggcagaatacctccaagtttggtaatctcaggttgataaaatag

SEQ ID NO: 52 - protein, 1053 aa, Unknown
  Obtained from an environmental sample
  SIGNAL (1)...(30)
MRGKSKKGFLNISEAVLVGILAGFLGVLLAATGVLSFGGTASSSLETVFTLSFEGTTQGVNPFGKEVVLTASQDVAADGEYSLKVENRTSGWDGVEIDLTEKVEANKDYLLSFYVYQTSDSPQLFEVLARTEDGKGEKYETLTDKVVVSNYWKEILVPFSPSFESTPTKCSLIVVSPKNPSFTFYIDKVQILKPKKQGPQVIYETSFESGTGSWQARGSDVKIKVTSKVAHSGKRSLYVSNRQKGWHGVQLDVKRLLRPGKTYAFEGWVYQDSGQDQTIILTMQRRYSSDSSTQYEWIKAVTVPSGQWTQISGTYTIQPRVSVEELIVYFEAKDPTLAFYVDDFKITDTTTTDIKLELKPEEEIPALKEVLGDYFKVGVALPFKVFAKPEDIALITKHFNSITAENEMKPESLLAGVENGKLKFRFETADKYVEFAQQNGMVVRGHTLVWHNQTPDWFFKDENGNLLSKEAMTERLREYIHTVVGHFKGKVYAWDVVNEAVDPSQPDGLRRSIWYEIMGPDYIELAFKFAREADPNAKLFYNDYNTYQEKKRDIIYNLVKSLKEKGLIDGIGMQCHIGVGTSVKEIEEAIKKFSTIPGIEIHITELDISVYEDATSNYPTPPREALIKQAHVMRELFAIFKKYSNVITNVTFWGLKDDYSWKNARRNDWPLLFDKDYQAKLAYWAIVSPEALPVLPKKWSIATGSALVVGMMDDSYLASSPIKILVDGQEKLTARVIWEENKLFVYAEVYDRTRDKGKDGITIFVDPKNFKAPYLHEDAFYVTIKTDWSVEKSRDDIEVQRFVGPSGVRYNVECEITLPEKLQEGQQIGFDIAVQDGDKVYSWSDTSNQQKLATMNYGTLTLQGAVMATAKYGTPVIDGEIDDIWYTTEEISTDVVVMGSLKNARAKVRVLWDEEHLYVLAIVTDPVLNKDNTNPWEQDSVEIFIDENNAKTPYYQDDDAQYRVNYLNEQSFGTGASSKNFKTAVKLIDGGYLVEAAVKWKTIKPSPNTVIGFDFQVNDANAQGKRVGILKWCDPTDNSWQNTSKFGNLRLIK

SEQ ID NO: 53 - DNA, 2370 bp, Bacteria
atgaagggcctgcaccggctccgccgccgtcgccggacctgggtggcaggactgtcggccgcggcggtggtcgccggcgccctgacgctcctccccggctccgccggcgccgcgggcctgggtacgcacgcggccccctcgggccggtacttcggcacggccgtggccgcgggccgcctcggcgactcggcgtacaccgcgatcgccgaccgggagttcaacatgatcaccccggagaacgagatgaagtgggacgccgtcgagccgtcccgcggccgtttcgacttcggtcccgcggaccggatcgtcgagcgtgccctggcacgcggccagcgcgtccgcggccacaccacggtctggcactcgcagctcccctcctgggtgggctccatccgcgacacgaagacgctgcgcggcgtgatgaaccaccacatcaccacccagatgacccactacaagggcaagatctacgcctgggacgtggtcaacgaggccttcgccgatggcggcagcggccggctccgcgactcggtcttccagaaggtgctgggcgacggcttcatcgaggaggcgttccgcaccgcccgcgcggccgacccctcggccaagctctgctacaacgactacaacatcgagaactggtcggacgccaagacccagggcgtctaccgcctggtgaaggacttcacgtcccgaggcgttcccatcgactgcgtcggcttccagagccacttcggcgcgggcggcccgccggcgagcttcaagacgaccctggccaacttcgccgccctgggcgtcgacgtccagatcaccgagctggacatcgcccaggcatcacctgcccactacgcgagtgcggtcagcacctgtctgtccgtggcccggtgcaccggcatcacggtgtggggcgtccgtgacagcgactcctggcggagcgccgaaagcccgctgctgttcgaccggaacggcaagcccaagcccgcgtacgccgccgtcatgaacgccctcggctccggctcgggtcccaccccgagcaagccggccgacggtacggggagcggtacgggggagatcaagggcgtggcctccggccgctgtctggacgtccccgcctccaccaccgccaacggcacccgggcgcagctgtgggactgtagcggccaggccaaccagcgctggacccacaccgccggcaagcagctgaagatccacggcgacaagtgcctggacgccaagggcaagggcaccgccaacggcaccgcggtggtcgtctgggactgcaacggcggcaccaaccagcagtggaacgtccacaccgacggcacgatcaccggcgtccagtccggtctgtgcctcgatgccgtcggcgcggccaccgccaacggcaccccgatccagctgcacgcctgtgggggtgtcggcaaccagaagtggtccgccccgtccggatcgggcggcggcacgtgcgtgcttccgtcgacgtacaagtggagctcgacgggtgccctggcgcagcccaaggccgggtgggcctcgctgaaggacttcacccatgtggtgctgggcggcaagcacctggtctacgggtcgaacttcaacggatcgacgtacggctcgatgacgttcagccccttcaccacctggtcggacatggcgtccgcaggacagaaggcgatgaagcagcccgcggtcgcacccaccctgttctacttcgcacccaagaagatctgggtgctggcgtaccagtggggcaggaccgcgttctcctaccggacgtcgaccgaccccaccaacccgaacggctggtcggcggagcaggagctcttctccggaagcatcaccggctcgggcacgggccccatcgaccagacgctcatcggcgacgggacgaacatgtacctgttcttcgccggtgacaacggcaagatctaccgggccagcatgccgatcgggaacttcccgggcagcttcggctcctcgtacacgacggtcatgagcgacaccgcgaagaacctgttcgaggcgccgcaggtgtacaaggtcaaggaccagaaccagtacctcatgatcgtcgaggcccggggcgcgggcgagcgccgctacttccgctcgttcacggcctccagcctgagcggtgcgtggaccccgcaggccgcgaccgagagcaaccccttcgcgggcaaggccaacagcggcgccacctggaccgacgacatcagccacggtgatctgatccgcaccaaccccgatcagaccatgaccatcgacccctgcaaccttcagctgctctaccagggcaagtccccgcaggcgggcggaccctacgaccagctgccgtaccggccgggcgtcctcaccctgcagcgctga

SEQ ID NO: 54 - protein, 787 aa, Bacteria
  SIGNAL (1)...(37)
MKGLHRLRRRRRTWVAGLSAAAVVAGALTLLPGSAGAAGLGTHAAPSGRYFGTAVAAGRLGDSAYTAIADREFNMITPENEMKWDAVEPSRGRFDFGPADRIVERALARGQRVRGHTTVWHSQLPSWVGSIRDTKTLRGVMNHHITTQMTHYKGKIYAWDVVNEAFADGGSGRLRDSVFQKVLGDGFIEEAFRTARAADPSAKLCYNDYNIENWSDAKTQGVYRLVKDFTSRGVPIDCVGFQSHFGAGGPPASFKTTLANFAALGVDVQITELDIAQASPAHYASAVSTCLSVARCTGITVWGVRDSDSWRSAESPLLFDRNGKPKPAYAAVMNALGSGSGPTPSKPADGTGSGTGEIKGVASGRCLDVPASTTANGTRAQLWDCSGQANQRWTHTAGKQLKIHGDKCLDAKGKGTANGTAVVVWDCNGGTNQQWNVHTDGTITGVQSGLCLDAVGAATANGTPIQLHACGGVGNQKWSAPSGSGGGTCVLPSTYKWSSTGALAQPKAGWASLKDFTHVVLGGKHLVYGSNFNGSTYGSMTFSPFTTWSDMASAGQKAMKQPAVAPTLFYFAPKKIWVLAYQWGRTAFSYRTSTDPTNPNGWSAEQELFSGSITGSGTGPIDQTLIGDGTNMYLFFAGDNGKIYRASMPIGNFPGSFGSSYTTVMSDTAKNLFEAPQVYKVKDQNQYLMIVEARGAGERRYFRSFTASSLSGAWTPQAATESNPFAGKANSGATWTDDISHGDLIRTNPDQTMTIDPCNLQLLYQGKSPQAGGPYDQLPYRPGVLTL

SEQ ID NO: 55 - DNA, 1143 bp, Unknown
  Obtained from an environmental sample
atgaaaaaaacgattgcacatttcaccttatggatagcgttttttctcttcacttcctgtgctgttacggcgcagaagaatactaagaatgcaagagtaaagcccactactctaaaagaggcttaccaaggtaaattctatatcggtacagcgatgaatctgagacagattcacggagatgatccccagtctgaaaatattatcaaaaaacagttcaattccattgttgctgaaaactgcatgaagagtatgtatcttcagccggaggaaggaaaatttttcttcgatgatgcggataagtttgtggattttggtcttcagaacaatatgtttattatcgggcattgtctgatttggcattcgcaggcgccaaaatggtttttcaccgacgagaatgggaaaacggtctccccagaagttcttaaacaaaggatgaaagctcatatcaccgccgtcgtttctcgctacaaagggaaaatcaaaggatgggatgtggtgaacgaagccattatggaagatggttcttaccgcaaaagcaaattttacgagattttgggagaagaatttattccgttggcatttcagtatgcgcatgaagcagatcctgatgcagaactctattacaacgattataacgaatggtatcccggaaaaagagctacggtgaccaaaataatccgagatttcaaatctagaggaatccgcattgatgccattggaatgcaggctcatttcgggatggattcacccactatagaagagtatgaacaaactattcagggctatataaaagaaggcgtgaaagtcaatattacggaactcgatttgagtccacttccttccccttggggaacttccgccaacgttgccgatacgcagcagtatcaggaaaaaatgaatccttacaccaaaggacttcccacagaggtggaaaaagcttgggaaaaccgttatctcgattttttcaaactattcctaaaatatcatcagcatatcgagcgtgttacgttttggggcgttagcgatatcgattcctggaagaacgattttccagtgagaggacgtaccgattatccgttaccctttgaccgacagtatcaggcaaaacctttggttcagaaattaatagacttaacgaaatag

SEQ ID NO: 56 - protein, 380 aa, Unknown
  Obtained from an environmental sample
  SIGNAL (1)...(24)
MKKTIAHFTLWIAFFLFTSCAVTAQKNTKNARVKPTTLKEAYQGKFYIGTAMNLRQIHGDDPQSENIIKKQFNSIVAENCMKSMYLQPEEGKFFFDDADKFVDFGLQNNMFIIGHCLIWHSQAPKWFFTDENGKTVSPEVLKQRMKAHITAVVSRYKGKIKGWDVVNEAIMEDGSYRKSKFYEILGEEFIPLAFQYAHEADPDAELYYNDYNEWYPGKRATVTKIIRDFKSRGIRIDAIGMQAHFGMDSPTIEEYEQTIQGYIKEGVKVNITELDLSPLPSPWGTSANVADTQQYQEKMNPYTKGLPTEVEKAWENRYLDFFKLFLKYHQHIERVTFWGVSDIDSWKNDFPVRGRTDYPLPFDRQYQAKPLVQKLIDLTK

SEQ ID NO: 57 - DNA, 1578 bp, Unknown
  Obtained from an environmental sample
atgaaaagaatgatcggtttgctgctggccatttgcctggtgatgacgctggctggggcctgggctgcctcggatacgctggtctatgcatccagtttcgcagcgggcgatgacgactggtttgcaaggggcgcttcccgggtttaccataccacggaggcgacgctgcggacggaaggccggagcgacaactggaattctccgggacgctattttgaactggtgccggataatgaatatacgctgagcgtggaggtctaccaggacggagcggacagcgcgaacttcatgatttccctggaaaaggttgcggatgggatcaccggatgggaaaacctggtgcggggaaccgtgaaaaagggtgaatggacgacgctgtccggaacctatacttttgcagactatgaaagctatgtgctgtatgtggagacctccgacgcgccgacgctggactttgagatccggaatttccgggtggaaagccccaatgggatcccggagccgaaggctaccgaggcgccggcagtggtttcggaagccacggatattccgagcctgaaggacgcttacgcggattacttcgactttggcgcggccgtgccgcagtctgctttcaccagcagagataatattcagctgatggagctgatgaaaaaccagttcagcatcctgacgcctgaaaatgagctgaagccggacagtgtattggatgtaagcgccagcaagcagctggccaaagaggatgaaaccgcggtagtggtgcggtttaacggggcaaagtcattgctgcggtttgcccagcaaaacggcatcaaggtgcacgggcatgtgctggtctggcacagccagacgccggaagcctttttccatgaaggatatgatcccaagaacccgctggtgagccgggaagtgatgctgggacggctggaaaactatatccgggaagtgctgacccagacggaagaactgtatccgggcgtgatcgtcagctgggacgtggtgaacgaagcgattgacgacggaaccaactggatccggaagggatcgggctggtaccggaccatcggggaagactatgtggagaaggcttttgagtttgcccggaagtatgccccggaaggcgtgctgctgtactacaacgattacaacacggcatacgccggaaaactgaatgggattatcaaactgatcaaacccatgatcgagcagggaacgatcgacggatacggcttccagatgcaccatacgaccgggcagcccagcaaccagatgatcaccacggcggtggagaagatcgcggccctgggaatcaagctgcgggtcagcgagatggacatcgggattacaaagtatacagagacgagcctgcaggcacaaaaggacaagtacaaggcgatgatggaactgatgctgcggttcgcggaccagacggaagcagtgcaggtctgggggattacggatacgatgagctggcggagctccagctatccgctgctgtttgaccggagcaggaatccgaagccggcgttctatggcgtgattgaagcggttgaagactggacagggaaaagtgaatag

SEQ ID NO: 58 - protein, 525 aa, Unknown
  Obtained from an environmental sample
  SIGNAL (1)...(22)
MKRMIGLLLAICLVMTLAGAWAASDTLVYASSFAAGDDDWFARGASRVYHTTEATLRTEGRSDNWNSPGRYFELVPDNEYTLSVEVYQDGADSANFMISLEKVADGITGWENLVRGTVKKGEWTTLSGTYTFADYESYVLYVETSDAPTLDFEIRNFRVESPNGIPEPKATEAPAVVSEATDIPSLKDAYADYFDFGAAVPQSAFTSRDNIQLMELMKNQFSILTPENELKPDSVLDVSASKQLAKEDETAVVVRFNGAKSLLRFAQQNGIKVHGHVLVWHSQTPEAFFHEGYDPKNPLVSREVMLGRLENYIREVLTQTEELYPGVIVSWDVVNEAIDDGTNWIRKGSGWYRTIGEDYVEKAFEFARKYAPEGVLLYYNDYNTAYAGKLNGIIKLIKPMIEQGTIDGYGFQMHHTTGQPSNQMITTAVEKIAALGIKLRVSEMDIGITKYTETSLQAQKDKYKAMMELMLRFADQTEAVQVWGITDTMSWRSSSYPLLFDRSRNPKPAFYGVIEAVEDWTGKSE

SEQ ID NO: 59 - DNA, 1104 bp, Unknown
  Obtained from an environmental sample
atgcttgccagtagtgccggtttggtagcatcccaactcaagctgtccgcgttagctgcagctaaaaatgctggattaaaagatgtatataaggatcgctttctgattggtgcagcaattaatacctcgattgcgagcggccagcaacctgatattacagaaattatcaagcgtgatttttcgtcgttaacacctgaaaatgcaatgaagtgggaatctgtcaggactgctgatggcggatggaaatgggcagatgccgatcaattcgttacgtttgcaacagaacacaaaatacacgctgttggccacacccttgcctggcatagccagattcccgattccgtattcaaaaatgaaaaaggcgaatacataaaatccaccgagctatcaaaaaaaatggaagaacatatcactacgattgtaggtagatataaaggcaaactcgatgcctgggatgtagttaatgaggctgttggtgatgataatcaaatgcgcaaaagccattattacaatattctcggcgaagattttattgataaggcatttcaccttgcgcatgaggtcgatcccaaagcgcatttaatgtataacgactacaacattgaaaaagatggcaagcgtgaagctacccttgaaatgttaaagcgtttacaaaaacgcggtgtaccgattcatgggctcggcatccagggacatattgccgttgatggccccagcattgcggatattgaaaaaagtattttggcttatgcggatttgggtttgcgtgtacatttcaccgagttggatattgatgtattgccgcaaatctggaacttaccggttgcagaaatttctacacgcttcgaatacaaacctgagcgagatcctttcaaaaatggtttatcaaaagaaatgaacgataaactcagtgcacgctatgaagaattattcacattatttattaaacacaaagataaaattgatcgtattactttgtggggtgtcagcgatgatgcaacctggctaaatgatttccccatcaaaggcagaaccagttatccattattgtttgatcgcaagcatcaaccaaaagatgcttattataacattctggcgttgtga

SEQ ID NO: 60 - protein, 367 aa, Unknown
  Obtained from an environmental sample
  SIGNAL (1)...(21)
MLASSAGLVASQLKLSALAAAKNAGLKDVYKDRFLIGAAINTSIASGQQPDITEIIKRDFSSLTPENAMKWESVRTADGGWKWADADQFVTFATEHKIHAVGHTLAWHSQIPDSVFKNEKGEYIKSTELSKKMEEHITTIVGRYKGKLDAWDVVNEAVGDDNQMRKSHYYNILGEDFIDKAFHLAHEVDPKAHLMYNDYNIEKDGKREATLEMLKRLQKRGVPIHGLGIQGHIAVDGPSIADIEKSILAYADLGLRVHFTELDIDVLPQIWNLPVAEISTRFEYKPERDPFKNGLSKEMNDKLSARYEELFTLFIKHKDKIDRITLWGVSDDATWLNDFPIKGRTSYPLLFDRKHQPKDAYYNILAL

SEQ ID NO: 61 - DNA, 1041 bp, Unknown
  Obtained from an environmental sample
atgagaagaagcatggaaaggctgcccaagctccatgaagcttacggcaatagtttcaagatcggcgctgccgtgaatccaattacgatggtgacccaaaaggaattgttgtcacaccacttcaacagcgttacggcagaaaatgaaatgaaattcgagcgattgcacccatcggaagaggtgtatacattcgagcaagccgaccagatcgtatcgtttgccaaatcgaacggaatgtcggtgagaggacataccctcgtatggcataatcagacgccggaatgggtgtttcaagacagttccggtgggacagccggccgcgagctgctgctcgctcggatgaaatcgcacatcgatgaggtcgttggccgttatcgcggagatatctatgcttgggatgtcgtaaacgaagccattgccgacagtggaagcgatctgcttcgttcctccccgtggcttgcgtcgatcggggaggattttatcgccaaggctttcgaatatgcgcacgaagcagacccgcaagcgctgctgttttataacgattacaacgaatccgtgcccgagaagcgggagaagatttacacgctccttaaatcgttaaaggagcaggatgtgccgattcacggcgtcgggcttcaggcccattggaatttggagtttccatcgcttgacgatatccgcagggcaatcgaaaggtatgcaagccttggcatgatcttgcatatcacggagcttgacgtatccgtattcgcgcatgaggataagcggaccgatctggcggcgccgaccgaagaaatgcttgagcgccaggcggagcgttacggtcaattgttccgtctgcttaaagagtacagcggcagcgtcacttccgtgaccttctggggagcggcggacgattatacctggctggatcattttccggtaaggggccgcaaaaattggccgttcgtcttcgacgagaaccatcttccgaaggaatcctattggaacctgttgaaggaagccaatcccgaaagaacattccaagagatacgttcgtaa

SEQ ID NO: 62 - protein, 346 aa, Unknown
  Obtained from an environmental sample
MRRSMERLPKLHEAYGNSFKIGAAVNPITMVTQKELLSHHFNSVTAENEMKFERLHPSEEVYTFEQADQIVSFAKSNGMSVRGHTLVWHNQTPEWVFQDSSGGTAGRELLLARMKSHIDEVVGRYRGDIYAWDVVNEAIADSGSDLLRSSPWLASIGEDFIAKAFEYAHEADPQALLFYNDYNESVPEKREKIYTLLKSLKEQDVPIHGVGLQAHWNLEFPSLDDIRRAIERYASLGMILHITELDVSVFAHEDKRTDLAAPTEEMLERQAERYGQLFRLLKEYSGSVTSVTFWGAADDYTWLDHFPVRGRKNWPFVFDENHLPKESYWNLLKEANPERTFQEIRS

SEQ ID NO: 63 - DNA, 1110 bp, Unknown
  Obtained from an environmental sample
atgaaacgaattttaattggtttggcggctcttaccgcttccgggctgtcggcgcagaaatccgacggtactttaaaaaaagcatttcaggataaattctatatcgggactgcgatgagtcttcctcagattgatgggacagataaaagagcggtagccattatcagaaatcagttcagttctattgttgctgaaaactgtatgaaatcgatgtttctgcaacctcaggaaggaaagttcttctttgatgacgctgataaatttgttgatttcgggatgaaaaacaatatgttcgtcatcggacatacgctaatctggcattcccagcttccaaaatggttttttacagataaaaatggaaaagatgtttctccggaagtattgaaacagcgcatgaaaaaccacattacaaccgtagtttcccgttacaaaggaaaagtaaaaggatgggatgtggtgaatgaagccattcttgaagacggaacctatagaaaaagtaaattttacgaaattctgggtgaagattttattcctttggcgtttcagtatgcacaggaagccgatcccaatgcagaattatattacaacgattataatgaatggtatccggaaaaggtaaaagcagtcattacaatggttgaaaagcttaaatcaagaggaatccgtattgatggagtaggaatgcaggcccatgtcggaatggatatcccttccatcaatgaatatgaaaaagcaattctggcgtattccaatgccggagttaaagttaatattacggagctggaaattagtgcgctgccttctccgtggggaagctctgccaatgtttcagataccgttgcctatcagaaagaaatgaatccttacaccaaagggcttcccaatgaagtagaagcgaaatgggaaaaacgttaccttgatttctttagcttgtttttaaaacataaagataaaataagaagggtgaccttatggggagttactgataagcagtcctggaaaaacgattttccggtaaaaggaagaacagattacccgttgctgtttgacaggaaagatcaggagaaacctgtagtacaaaaaataataaaattggcagagaaaaattaa

SEQ ID NO: 64 - protein, 369 aa, Unknown
  Obtained from an environmental sample
  SIGNAL (1)...(20)
MKRILIGLAALTASGLSAQKSDGTLKKAFQDKFYIGTAMSLPQIDGTDKRAVAIIRNQFSSIVAENCMKSMFLQPQEGKFFFDDADKFVDFGMKNNMFVIGHTLIWHSQLPKWFFTDKNGKDVSPEVLKQRMKNHITTVVSRYKGKVKGWDVVNEAILEDGTYRKSKFYEILGEDFIPLAFQYAQEADPNAELYYNDYNEWYPEKVKAVITMVEKLKSRGIRIDGVGMQAHVGMDIPSINEYEKAILAYSNAGVKVNITELEISALPSPWGSSANVSDTVAYQKEMNPYTKGLPNEVEAKWEKRYLDFFSLFLKHKDKIRRVTLWGVTDKQSWKNDFPVKGRTDYPLLFDRKDQEKPVVQKIIKLAEKN

SEQ ID NO: 65 - DNA, 1557 bp, Unknown
  Obtained from an environmental sample
atgaaaagaatcggactgttgctgctggctgtgatcatgcttgtgggctgtgtatattccgcggcggcggaggatacgctggtttatgcttccacttttgtggccggaacggacggatggtacgcccgcggagcgcagaaagtataccgcacaaccgaggagacactgcggacggaaggccggaccagcgactggcattccccgggccgtgattttgacctggtggaaggcggcgtctatgtcctgagcgtggaagtgttccaggacgaagcggacaacgccagcttcatgatttccatcgcccacagcaaggacggtacggaaacctatgaaaacctggctcgcggaaccgccaaacgcggcgagtgggtcaccctgaccggaacatataccgccggcaattttgaccggaacgtcctgtatgtggaaacgaccggatcgccggaactgagctatgaaatccggaatttccgggttgaagcgccgaacggagttccggagccgaaggctacggagcccccgatggtgattgaggcggtggagaacctcccgggcctgaagaacgcgtatgcgggaaaatttgatttcggcgcggcggttccgggatacgctttcggcgatccgggcctgaaacagctgatgactgagcagttcagcatcctgacgcccgaaaacgaactgaaaccggacgctgtgctggacgtggcggcgagcaagcggctggcccaggaggatgaaacggcggtggcggttcattttgacggcgccattccgctgctgaactttgcccgggacaacggcatcagggtgcacggacatgtgctgatctggcacagccagacgccggaagcgttcttccatgagggctatgacacctccaagcccctggtcagccgggaagtgatgctgggccggatggaaaactatatccgcgaggtgctgacctggacgaacgagaattatccgggcgtgatcgtatcctgggacgtggtgaacgaagccattgatgacggaacgaactggctgcggaattccaactggtacaagacggtgggcggcgactttgtgaaccgggcttttgaatttgcccgcatgtacgcggcggacggcgtcctcctgtattacaatgattacaataccgcctatccggccaaacggaagggaatcatcaagctgctgggccagctgattgaggaaggcaatattgacggatacggcttccagatgcatcacagcaccggcgagccttccatggagatgatcaccgcttcggtggaggaaatcgccgcgctgggaataaaactgcgggtcagcgagctggatgtgggcatgggcagcagcatgacggaagaagccctgatgaaacagaaggacaaatacaaggcggtcatggaactgatgctgcggtttgccgaccagacggaagcggtgcaggtatggggactgacggacaatatgagctggcggaccggccagaatccgctgctgtttgaccggaaccggaacccgaagccggccttcttcggcgtcctggaagcggcggaagaaagcaaataa

SEQ ID NO: 66 - protein, 518 aa, Unknown
  Obtained from an environmental sample
  SIGNAL (1)...(22)
MKRIGLLLLAVIMLVGCVYSAAAEDTLVYASTFVAGTDGWYARGAQKVYRTTEETLRTEGRTSDWHSPGRDFDLVEGGVYVLSVEVFQDEADNASFMISIAHSKDGTETYENLARGTAKRGEWVTLTGTYTAGNFDRNVLYVETTGSPELSYEIRNFRVEAPNGVPEPKATEPPMVIEAVENLPGLKNAYAGKFDFGAAVPGYAFGDPGLKQLMTEQFSILTPENELKPDAVLDVAASKRLAQEDETAVAVHFDGAIPLLNFARDNGIRVHGHVLIWHSQTPEAFFHEGYDTSKPLVSREVMLGRMENYIREVLTWTNENYPGVIVSWDVVNEAIDDGTNWLRNSNWYKTVGGDFVNRAFEFARMYAADGVLLYYNDYNTAYPAKRKGIIKLLGQLIEEGNIDGYGFQMHHSTGEPSMEMITASVEEIAALGIKLRVSELDVGMGSSMTEEALMKQKDKYKAVMELMLRFADQTEAVQVWGLTDNMSWRTGQNPLLFDRNRNPKPAFFGVLEAAEESK

SEQ ID NO: 67 - DNA, 1224 bp, Unknown
  Obtained from an environmental sample
atgcggaacgtcgtgcgtaaaccattgacaatcggactcgctttaacactattattgcccatgggaatgacggcaacatcagcgaagaatgcagattcctatgcgaaaaaacctcacatcagcgcattgaatgccccacaattggatcaacgctacaaaaacgagttcacgattggtgcggcagtagaaccttatcaactacaaaatgaaaaagacgtacaaatgctaaagcgccacttcaacagcattgttgccgagaacgtaatgaaaccgatcagcattcaacctgaggaaggaaaattcaattttgaacaagcggatcgaattgtgaagttcgctaaggcaaatggcatggatattcgcttccatacactcgtttggcacagccaagtacctcaatggttctttcttgacaaggaaggcaagccaatggttaatgaaacagatccagtgaaacgtgaacaaaataaacaactgctgttaaaacgacttgaaactcatattaaaacgatcgtcgagcggtacaaagatgacattaagtactgggacgttgtaaatgaggttgtgggggacgacggaaaactgcgcaactctccatggtatcaaatcgccggcatcgattatattaaagtggcattccaaacagcgagaaaatatggcggcaacaagattaaactttatatcaatgattacaataccgaagtggaaccaaagcgaagcgctctttataacttggtgaagcaattaaaagaagagggcgttcctattgacggcatcggccatcaatcccacattcaaatcggctggccttctgaagcagaaatcgagaaaacgattaacatgttcgccgctctcggcttagacaaccaaatcactgagcttgatgtgagcatgtacggttggccgccgcgcgcttacccgacgtatgacgccattccaaaacaaaagtttttggatcaggcagcgcgctatgatcgtttgttcaaactgtatgaaaagttgagcgataaaattagcaacgtcaccttctggggcatcgccgacaatcatacgtggctcgacagccgtgcggatgtgtactatgacgccaacgggaatgttgtggttgacccgaacgctccgtacgcaaaagtggaaaaagggaaaggaaaagatgcgccgttcgtttttggaccggattacaaagtcaaacccgcatattgggctattatcgaccacaaatag

SEQ ID NO: 68 - protein, 407 aa, Unknown
  Obtained from an environmental sample
  SIGNAL (1)...(28)
MRNVVRKPLTIGLALTLLLPMGMTATSAKNADSYAKKPHISALNAPQLDQRYKNEFTIGAAVEPYQLQNEKDVQMLKRHFNSIVAENVMKPISIQPEEGKFNFEQADRIVKFAKANGMDIRFHTLVWHSQVPQWFFLDKEGKPMVNETDPVKREQNKQLLLKRLETHIKTIVERYKDDIKYWDVVNEVVGDDGKLRNSPWYQIAGIDYIKVAFQTARKYGGNKIKLYINDYNTEVEPKRSALYNLVKQLKEEGVPIDGIGHQSHIQIGWPSEAEIEKTINMFAALGLDNQITELDVSMYGWPPRAYPTYDAIPKQKFLDQAARYDRLFKLYEKLSDKISNVTFWGIADNHTWLDSRADVYYDANGNVVVDPNAPYAKVEKGKGKDAPFVFGPDYKVKPAYWAIIDHK

SEQ ID NO: 69 - DNA, 1596 bp, Unknown
  Obtained from an environmental sample
atggcgatgcatagatttaagcaattaggggccatcctacttgtcctatggttttgtgcattgccagtgcaggcgcaggcttggcgtgcggccgcagagcagcgtattgaacagtaccgtaaggggccactgcgggttcaggtgaaggatcctgaaggacggcccgtaccgaatgcccaagtgcacgttcgcatgacgcgtcacgcttttggatttggtacggctgtcagctttggcctggtcgtggggtcgggatacaaccccacctatcgggccaagctagaagacctgacgggcgacggccgcacattcaacatggctacgccagagaatgaattgaagtggcctgcgtgggagtcggaatggcccatttcgaatcgtcgaaagatcgacgtcatcaactggctgcgcgcaaaaggctacagcattcgaggacacaacctgctatggcctgactggcaatggatgccccgtgatattgagcaaaaccgcaacaatccacagtacatctacgatcgcgttcgcaatcacattgcggcgttggctgggcatcgggacattcggggcaaactgcgggactgggatgttcttaacgaaccagcccacctgaccgcattgcgcgatgtgtttaacggttggggctcatatgagcgtggggaagacttctatgtggatgtctttaggtgggccaaggcagcagactcgaccgcccgtctatacatcaacgagtacaacattatcaacaactacgccaacgagcagcctacgcgcaactattacaagtggatcattgcacgcctaatctcaaaaggagcgcctatcgaagggatcggcattcaggggcatatttcggcaccactgccaagcatgagtgaggtcaaggcagccctagacgaaatggcagtttttggattgcctttggccatcacagaatacgacgttaccggcgtttcggaagaagtcgaagccaactttatgcgggactttttgaccatggtctttagtcatcccgctgtggagagcttcgtcatgtggggtttctggagcggagcacactggcgtgacaatgcgccgctgtttcgggccgactggagtctcaagccttcgggacaggtgttccttgatctggtctttcggcgctggtggaccgatactacgggggtaaccggtccagatggcagctggtctgtacgcggatttttaggggattacgttgtggaagtgcaggtgggggaggtttcagtgaccaagtccctgcgcctcgaaagcccgcaggatacaaccacgctagaggtggtggtcagtagcgttaaggtgggtgaaaagcctacagaagacgtgttgcgcgtgcaagggtttggaccagacccctttgtcgaaggaacggcgctgcgctactggttagggcggccggccgatgttgaactggcagtgtatgatgtgctgggccgacaggtctacgccgtgcaaaagcatcgcgtagctggttggcatactgaatgggtcgaggcttcccactggcctgcaggactttatctgtaccgactccaagcaggtgatctgttgcacacgggtagaatggtcaagatccaataa

SEQ ID NO: 70 - protein, 531 aa, Unknown
  Obtained from an environmental sample
  SIGNAL (1)...(25)
MAMHRFKQLGAILLVLWFCALPVQAQAWRAAAEQRIEQYRKGPLRVQVKDPEGRPVPNAQVHVRMTRHAFGFGTAVSFGLVVGSGYNPTYRAKLEDLTGDGRTFNMATPENELKWPAWESEWPISNRRKIDVINWLRAKGYSIRGHNLLWPDWQWMPRDIEQNRNNPQYIYDRVRNHIAALAGHRDIRGKLRDWDVLNEPAHLTALRDVFNGWGSYERGEDFYVDVFRWAKAADSTARLYINEYNIINNYANEQPTRNYYKWIIARLISKGAPIEGIGIQGHISAPLPSMSEVKAALDEMAVFGLPLAITEYDVTGVSEEVEANFMRDFLTMVFSHPAVESFVMWGFWSGAHWRDNAPLFRADWSLKPSGQVFLDLVFRRWWTDTTGVTGPDGSWSVRGFLGDYVVEVQVGEVSVTKSLRLESPQDTTTLEVVVSSVKVGEKPTEDVLRVQGFGPDPFVEGTALRYWLGRPADVELAVYDVLGRQVYAVQKHRVAGWHTEWVEASHWPAGLYLYRLQAGDLLHTGRMVKIQ

SEQ ID NO: 71 - DNA, 1269 bp, Unknown
  Obtained from an environmental sample
atgatttccatcgcccattcagtgaacggggcggagacctatgagaacctggcgcacggaactgccaaaaaaggcgaatggactacgctgaaggggacatacaccgccggcgcctatcagcgcaacgtgctctatgtggaaacggtttctgaaggcacccttgactttgagatccgtaattttgtcctgacggctccgaacggactaccggagcccaagccgaccgagcctccgatggtcatcgaggaagccgagaacgtgcccagtctcaaagagatttatgcagacaaattcgatttcggctccgccgcgccccagatggtattccgtgaccccaaatggctcaacctgatgaaggaacagttcagcattctgacgccggaaaacgaaatgaaaccggattccgttctggatgtgggcgcgagcaaagcgctggtgaaggaaaccggtgatgagaccgccgtcgccgttcatttcgacgctgccaaagcgctgctgaattttgccaagagcaacgggatcaaggttcacggccatgtgctgatctggcacagccagacgccggaagctttcttccatcagggatatgattccaagaagcctttcgttacacgggaagtgatgctgggccgaatggaaaattacattaagggtgtttttgaatacctggatgaaaattatcccggcgtcgttgtctcctgggacgtgctgaatgaggcgattgacgacggaagcaactggctgcggaacagcaactggagaaagattgtcggcgaagactatccgaaccgggcatatgaatatgcgcgcaaatatgcgccggaaggtacgctgctgtattacaacgattacaatacgtcgattcccgggaaactgaacggcattgtgaaactgctgaacagtctgattccggaaggaaatatcgacggttacggcttccagatgcaccatggcgtcggcttcccgtccattgatatgatccagactgcagtggaacggattgccgcgctgaatatccgccttcgcgtcagcgaactggatgtcacggtggacaacaacacggaagcgtccttcaacaaacaggcaaagtattatgccgaagtcatgaagattctgattgctcacagcgaccagtttgaggctgtgcaggtctgggggctgacagacctgatgagctggcgcggcagtcagttcccgctgctgtttgacggggcaggcaatccgaaaccggcgttctgggccgtcgcggatccggattccgtgaaataa

SEQ ID NO: 72 - protein, 422 aa, Unknown
  Obtained from an environmental sample
MISIAHSVNGAETYENLAHGTAKKGEWTTLKGTYTAGAYQRNVLYVETVSEGTLDFEIRNFVLTAPNGLPEPKPTEPPMVIEEAENVPSLKEIYADKFDFGSAAPQMVFRDPKWLNLMKEQFSILTPENEMKPDSVLDVGASKALVKETGDETAVAVHFDAAKALLNFAKSNGIKVHGHVLIWHSQTPEAFFHQGYDSKKPFVTREVMLGRMENYIKGVFEYLDENYPGVVVSWDVLNEAIDDGSNWLRNSNWRKIVGEDYPNRAYEYARKYAPEGTLLYYNDYNTSIPGKLNGIVKLLNSLIPEGNIDGYGFQMHHGVGFPSIDMIQTAVERIAALNIRLRVSELDVTVDNNTEASFNKQAKYYAEVMKILIAHSDQFEAVQVWGLTDLMSWRGSQFPLLFDGAGNPKPAFWAVADPDSVK

SEQ ID NO: 73 - DNA, 4455 bp, Unknown
  Obtained from an environmental sample
atgcagaaaatgagaagaaaattgaaaagaattatgttattacttctggcagctatgttgataatcccgtcaggctggattacacaggcttcagcagcggaaacaaacaaagatatacctgttctactgtaccatcgaattgttgataatcctactaatcaatggacggataccagcgttgaaacgtttaaacagactatgcaatatctaaatgatagcggttacaacaccttgtcagccgaacaatatgtaaagatcatggatggaacggcaacggcgcctgaaaaaccgattctattaacgtttgacgatggtactccagaatttatcaccaatgctcttccagtattaaagcaatataacatgaaagctgttctgtttattgtcagtgactggataggcggcggcttcagcatgtcaaaagaacagctgcaaagtttggctaatgaaccatctttaagcctcgaaaatcatacgaaaacccatgacggtactatttggggaacaaatggcggtgtacgtagtacgataacgaaagaacaagctgaggaccaaattatatcagcgaatacttatcttaaaagtattacaggtaaagacccagtcctaatggcatacccttatggcagctataatgatattgcaaaactagtaaaccaagaaaatggtattaagtacgcatttaaagtgggataccctaatgaagataattatgctatgggccgtcactatgtaacaaatcaaagtgtggctcaaattgcccaaatgattggcggccctgtgccagaaccaactccagaaccaggaaaccagacagaaaccgtctatcaagaaacctttgccagtgatattggtgtagcagttcaagcgggtaacccacaagtaacccacgtttctggtatggtttttgcaggcaatgacgatggaaaagccatctctgttagcggcaggacgaacaactgggacggcgtcgatatcccattcaacaatgtcggtatggaaaacggcaaaacttatacgattacagttactggttatgttgacgaaaatgcaactgttccttctggcgcacaagctttactgcagaatgtagacagctataacggtttgtatgttgccgcagattatgcagcgggacaggcttttactttaacgggtcagtataccgtggatactagtaaagatagagccctacgtatccaatcaaatgatgctgggaaaactgttccgttttacattggaaacatcttgattacaacgaaaaaaacgactgcgcctgaaacagatagagtggtatttcacgaaacatttggaaatggtgttggtgttgctacacaagcgggaagtgcgaaattgactcctgtttctgagcttgtttttgaaggcaatagcgatggaaaagcaatttctgttaatggcagatccaataactgggacggagttgatataccgttcagcagtgtcagcatgcagaacggcaaagcctataccattacagtcactggttttgtttatagcagtgtgagtgttcctgaaggtgcacaagctttgcttcagaatgtagacagctataatggcttgtatgcagcagcagatgttaaggcaggtcaaacatttactctaacgggtcaatataccgttgatacgagcaaagatagagcactacgaattcaatcaaatgatgcagggaaaaccgttcccttctatatcggagatattctcattaccgagaaggcagcctctggtggtggcggggacgatggaagactacctgccgaaccatttacagcaattaattttgaagaccaaaatatgggtggtttcgagggaagagctggtaccgaaacactaacagtaaccaatgaagccaatcatactgatggcggttcctatgctttgaaggttgaaggcagatcacaagcttggcatggaccagcattacacgtagagaaatatgttgacaaggattcggaatataaaatttctgcctgggtgaagctgatttcaccagcaacttcacagcttcagctttctacacaggtcggcaatggcggaactgctagttacaataatcttcaaggaaaaactatcagcactgaagatggctgggttaaacttgagggaacgtaccgttatagcagtgtaggcgatgagtttttaaccatttatgtagagagctcgaataatagcacagcctccttttatatcgatgatattacttttgaatcgactggttcgggtccgattgaagttgaggatttgacaccgataaaagatgtttatcaagacgatttcttaattggaaacgctgtctcagcttctgatcttgaaggcaatagacttaagcttctcaacatgcatcacaatgttgtcacagcagagaatgcaatgaagccagatcaagcgtataatgcggaaaaacaatttgactttactgatgaaaatgcgcttgtcgacaaggttttggatcagggattgcagctgcatggtcacgtgcttgtatggcaccagcagacgccagaatggttatttacagctgaaaacggtgcccctttgagccgtgaggcagcactagcaaatttaaggacccatgttaaaacagtcgtagaaaattacggtaacaaggtaatttcatgggacgtggtaaacgaagcaatcatcgataacccgccgaacccaacggattggaaggcatcacttcgtaaatctggctggtacaaatcgattggaccagacttcgtagaacaatccttccttgctgcaaaagaggtactgaatgaaaaaggcttgaatatcaagctatattacaatgattacaatgatgataatcagagcaaagccgaggccatttatcagatggtgaaagatatcaatgaaaagtatgctaaagaacatgatggggatcttctcattgacggaattggaatgcaagcgcactacaataaaaacactaatcctgaaaatgttaaactctccctagagaagtttattacattgggtgtagaagtcagtgtgactgaacttgacattaccgctggaaccaataatgtacttactgagaaggaagcaattgcacagggttatttatacgcacaattgttcaagatttacaaagaacacgcagagcatatctcacgggtaactttctggggactaaatgatgcaacgagctggagagctgcacagagtccattgttgtttgataaagatttgcaagcaaaaccagcttactatgctgttatcgatccagacacatttactgtagaaaatcaacctgaggtaagagaggctaatcaaggaagtgctgtttccggcacaccagtgattgatggaactgtagatggtgtttggagcaatgcaacggaactgccgattaatcgcttccaaatggcttggcagggagcaaacggggtatccaaggtcctctgggataatgaaaacctgtatgttttaattcaagtaagtgactcacagctcgacaaatcgagtccaaatccatgggaacaggattccattgaagtctttgtagatgagaataatgcaaagacatcttccttcgaagatggtgatggacaatatcgagtaaactttgacaatgaaacatcctttaaccctgtcagagttggagaaggtttcgaatctgcaaccaaagcatcaggtaatggctataccgttgaagtaaagattccgttcaaaaccattacaccagataacaatacgaaaatcggttttgatgttcagattaatgacggtaaagatggtgctcgtcaaagtgctgcaacatggaacgatttaactggtctgggatatcaggacacttctgtgttcggcgtcctgacacttatgaagactgacaccaccgcgcctgttacaaccgataacggaccagaagattgggttaataaagatgtaacgattgctttcagtgcaaatgataatgacactggtgtggcggcaacctattatagtattgataatggggtcgtacaaaacggtaattcagttactatttcggaagagggtgtccacattctaacatattggagtgtagacaaagctggtaatgtcgagcaggttcatacaaaaacaattaaactagataagaccggaccaatattagatattaaactcgacaaaacaacattatcaccagttaatcataagatggtcccaatatcggcggctattagtgcatctgatgccgattcaggaattcattcagtagtgttaacatcaattactagcaatgaatctatccaacctgatgatattcagaatgccaactataataaacctattacaggtactacggattcctttaaacttcgtgcagaaagattagcaaacggtaatggccgtgtttacaccattacttatacggccacagataaagctggtaatgtgacaacaaaaagtgttgaagtttccgttccacgcgacaattctaaaaaataa

SEQ ID NO: 74 - protein, 1484 aa, Unknown
  Obtained from an environmental sample
  SIGNAL (1)...(21)
MQKMRRKLKRIMLLLLAAMLIIPSGWITQASAAETNKDIPVLLYHRIVDNPTNQWTDTSVETFKQTMQYLNDSGYNTLSAEQYVKIMDGTATAPEKPILLTFDDGTPEFITNALPVLKQYNMKAVLFIVSDWIGGGFSMSKEQLQSLANEPSLSLENHTKTHDGTIWGTNGGVRSTITKEQAEDQIISANTYLKSITGKDPVLMAYPYGSYNDIAKLVNQENGIKYAFKVGYPNEDNYAMGRHYVTNQSVAQIAQMIGGPVPEPTPEPGNQTETVYQETFASDIGVAVQAGNPQVTHVSGMVFAGNDDGKAISVSGRTNNWDGVDIPFNNVGMENGKTYTITVTGYVDENATVPSGAQALLQNVDSYNGLYVAADYAAGQAFTLTGQYTVDTSKDRALRIQSNDAGKTVPFYIGNILITTKKTTAPETDRVVFHETFGNGVGVATQAGSAKLTPVSELVFEGNSDGKAISVNGRSNNWDGVDIPFSSVSMQNGKAYTITVTGFVYSSVSVPEGAQALLQNVDSYNGLYAAADVKAGQTFTLTGQYTVDTSKDRALRIQSNDAGKTVPFYIGDILITEKAASGGGGDDGRLPAEPFTAINFEDQNMGGFEGRAGTETLTVTNEANHTDGGSYALKVEGRSQAWHGPALHVEKYVDKDSEYKISAWVKLISPATSQLQLSTQVGNGGTASYNNLQGKTISTEDGWVKLEGTYRYSSVGDEFLTIYVESSNNSTASFYIDDITFESTGSGPIEVEDLTPIKDVYQDDFLIGNAVSASDLEGNRLKLLNMHHNVVTAENAMKPDQAYNAEKQFDFTDENALVDKVLDQGLQLHGHVLVWHQQTPEWLFTAENGAPLSREAALANLRTHVKTVVENYGNKVISWDVVNEAIIDNPPNPTDWKASLRKSGWYKSIGPDFVEQSFLAAKEVLNEKGLNIKLYYNDYNDDNQSKAEAIYQMVKDINEKYAKEHDGDLLIDGIGMQAHYNKNTNPENVKLSLEKFITLGVEVSVTELDITAGTNNVLTEKEAIAQGYLYAQLFKIYKEHAEHISRVTFWGLNDATSWRAAQSPLLFDKDLQAKPAYYAVIDPDTFTVENQPEVREANQGSAVSGTPVIDGTVDGVWSNATELPINRFQMAWQGANGVSKVLWDNENLYVLIQVSDSQLDKSSPNPWEQDSIEVFVDENNAKTSSFEDGDGQYRVNFDNETSFNPVRVGEGFESATKASGNGYTVEVKIPFKTITPDNNTKIGFDVQINDGKDGARQSAATWNDLTGLGYQDTSVFGVLTLMKTDTTAPVTTDNGPEDWVNKDVTIAFSANDNDTGVAATYYSIDNGVVQNGNSVTISEEGVHILTYWSVDKAGNVEQVHTKTIKLDKTGPILDIKLDKTTLSPVNHKMVPISAAISASDADSGIHSVVLTSITSNESIQPDDIQNANYNKPITGTTDSFKLRAERLANGNGRVYTITYTATDKAGNVTTKSVEVSVPRDNSKK

SEQ ID NO: 75 - DNA, 1122 bp, Unknown
  Obtained from an environmental sample
atgaaaaagcatattgtactcttcgcatttctttccgtgattttgctggcggcccgatcgtcggcgtcggagcgatttctcaaggacgtcttttcggattccttcaaggtcggcgtagccctcaatgccgatcagattacgggggcggactcggccagcctcgacttgtccttggctcacttcgattctcttgtcgctgaaaatgcgatgaagtgggggtcgctcaatcctgagccgggggtttacgatttccgggtggctgacgccctggtcgatttggcggagcgggaaggtttgtttttggttggccacacactgctctggcatcagcagacgccggactgggtttttctggacgagaagggcgagaccgccacgcgggagctggtgctcgctcgactggagacgcacatccgcaccgtggtcggccgctaccagggccgggtgcagggctgggatgtggtcaacgaagccttgaacgaagacggttcgttgcgggagtcgaaatggttgcagatcatcggcccggactacatcgaactggcgttccgcatggcgaaggaggccgatcccgacgccgagctttattacaatgactacaatgtgtccaagcccggcaagcgaggtggagtggtgcgcctgcttggagagctgcaggcgaaaggagttaaggtcgatgcggtcggcatccagggccactacagtctcgggcaccctgagctcgaccagctcgaggccagcatttctgcgataacggaggctggggctccgatcatgataaccgagctcgatgtgtcggtcttgccctttcccgacgcggagcaaatgggggcggacgtgtcgctcagctttgagatgcaggaccacctcaatccctatgccgatggcttgcccgaggcggtttcgcagcagctagctgaacgttacgcggccatttttgaagtgtttttgcgccaccagagccacatcgaccgcgtgacgttttggggagtgcacgacggggtcagctggtggaactattggccgatcgcgggcaggaccgactatcccttgctgtttgatcgggagctcaagcggaaagcggccttcgaggcggtggtcgatttagcggagggccgctga

SEQ ID NO: 76 - protein, 373 aa, Unknown
  Obtained from an environmental sample
  SIGNAL (1)...(22)
MKKHIVLFAFLSVILLAARSSASERFLKDVFSDSFKVGVALNADQITGADSASLDLSLAHFDSLVAENAMKWGSLNPEPGVYDFRVADALVDLAEREGLFLVGHTLLWHQQTPDWVFLDEKGETATRELVLARLETHIRTVVGRYQGRVQGWDVVNEALNEDGSLRESKWLQIIGPDYIELAFRMAKEADPDAELYYNDYNVSKPGKRGGVVRLLGELQAKGVKVDAVGIQGHYSLGHPELDQLEASISAITEAGAPIMITELDVSVLPFPDAEQMGADVSLSFEMQDHLNPYADGLPEAVSQQLAERYAAIFEVFLRHQSHIDRVTFWGVHDGVSWWNYWPIAGRTDYPLLFDRELKRKAAFEAVVDLAEGR

SEQ ID NO: 77 - DNA, 1248 bp, Unknown
  Obtained from an environmental sample
atgctaaaagttttacgtaaacctatcgtttctggattagctctagccttattattacctataggatcgacagttagtgccgaaacaaatatttcaaataaaccaggtattagcgggttaacagcaccacaattggaccaacgatataaagattctttcaccataggtgcagcggttgagccaaatcaattattagatgcaaaagactcacaaatgttaaagcgccattttaatagcattgtagcagaaaatgtcatgaagcctagcagtttacagccagtagaagggcagtttaactgggaaccggcagataaacttgttaagtttgcgaaagaaaatggaatggacatgcgcggccatacgcttgtctggcatagccaagtaccagattggttcttcaaagatgcaaatggaaattcaatggttgtttggcagaatggaaagcaagtggttgcagatccgtcaaatcttgaggctaacaaaaagcttttattaagccgtttagaaacacatgttaatacagtcgtttctcgttataaaaatgatattaaattttgggacgttgtcaatgaagtaatcgacgaatggggcggacatcctgaaggtttacgtcaatctccatggttcctaattaccggaacggactatattaaagtcgcttttgagacagcaagacaatatgctgctccagacgctaagctttatatcaatgattacaatacagaagtaacaccaaaaagaacgtacttatacaacctagtaaaaagtttaaaacagcaaggtgttccaattgatggtgttgggcatcagtctcacattcaaatcggctggccgtctgaaaaagaaattgaagacacaattaacatgtttgctgaactggggttagacaaccaaattactgagcttgatgtaagcatgtatggctggccagtaagggcgtatcctacctatgattctattccagcacagaaatttatagatcaagcagaccgatatgatcgtttatttaaattatatgagaaattaggcgataaaatcagcaatgtgacattctggggaattgctgataaccatacatggttaaatgaccgtgcagatgtttactatgatgcagatggaaacgttgtaacattggcaaatgcaccatatgctaaaatggaagctagatcaggtaaagatgcaccatttgtatttgatccagaatacaatgtaaaaccagcctattgggcgattatcgaccacaaataa

SEQ ID NO: 78 - protein, 415 aa, Unknown
  Obtained from an environmental sample
  SIGNAL (1)...(27)
MLKVLRKPIVSGLALALLLPIGSTVSAETNISNKPGISGLTAPQLDQRYKDSFTIGAAVEPNQLLDAKDSQMLKRHFNSIVAENVMKPSSLQPVEGQFNWEPADKLVKFAKENGMDMRGHTLVWHSQVPDWFFKDANGNSMVVWQNGKQVVADPSNLEANKKLLLSRLETHVNTVVSRYKNDIKFWDVVNEVIDEWGGHPEGLRQSPWFLITGTDYIKVAFETARQYAAPDAKLYINDYNTEVTPKRTYLYNLVKSLKQQGVPIDGVGHQSHIQIGWPSEKEIEDTINMFAELGLDNQITELDVSMYGWPVRAYPTYDSIPAQKFIDQADRYDRLFKLYEKLGDKISNVTFWGIADNHTWLNDRADVYYDADGNVVTLANAPYAKMEARSGKDAPFVFDPEYNVKPAYWAIIDHK

SEQ ID NO: 79 - DNA, 1293 bp, Unknown
  Obtained from an environmental sample
atgattggtctggatttgatttctggtggtcgtcgcaaggcctgtctggctgcctgtctggcgcttgccgcgctgtcattgccggtatcggctcaaatggctgcggggaaggaaaagttcgtgggtaacgtgatcgctggttatgtgcccggtgattacggcaatctctggaatcaggtgacgccggagaattccaccaagtggggagcggttgagtctacgcgtaatgtcatgaactggacgcaggctgatctggcctacaactacgccaagtccaagggcttcaagttcaagatgcacacgctggtatggggctcgcaagagccggcctgggtcaagaatctggatgcgacttcccagcgtgtcgaggtcgaacagtggatgcgtctgagctgcgaacgctaccccgattcctgggctatcgatgtggtgaatgaacccctgcatgccgtgccctcgtacaagaacgcactgggtggcgatggtgccaccggctgggattgggtcatcacctcgttccgtctggcgcgtcagtactgtccgcgcgccaagctgctgctcaatgagtacgccaccgagctggatgccagcaagcgcgccaagatcaagaccattgcctcgctgctcaagagtcgcggtctgattgatggtgttggcctgcaggcccatttcttcacgctggattacatgaatgccagccagatgaaggcggcactggatgattacgccacgctgggtgtggatatctacatttccgagctggatctgaagggcagtgccaataccgacgccagccagaaggcgaagtacgaagagctgttcccggtgatgtggaatcacgccagcgtgaagggcatcaccctgtggggctacaaggtgggtgaaacctggtcgagcggcaccggcctgctgaatgcgaacggtagcgagcgtccggccctgacctggctgaaaagctatatgagcagccgtcctgcagcatcgagcagcagttcttcgagtgtttcatccagcaaatccagttcgtcttcttctagccagtccagtgcctccagcagtgcaggcagtgcgccggtcttgtccggcaccagtgattacccgagcggtttcagcaagtgtgccgatctgggcggcacttgcagcgtgtcttccggcaccggctgggcggccttcgggcgcaagggtaagtgggttgccaaatacgtcggtgtgggcaagagcattccctgcacggtggcggcgtttggtcgtgacccggggggcaatcccaacaagtgttccttccagaggtaa

SEQ ID NO: 80 - protein, 430 aa, Unknown
  Obtained from an environmental sample
  SIGNAL (1)...(36)
MIGLDLISGGRRKACLAACLALAALSLPVSAQMAAGKEKFVGNVIAGYVPGDYGNLWNQVTPENSTKWGAVESTRNVMNWTQADLAYNYAKSKGFKFKMHTLVWGSQEPAWVKNLDATSQRVEVEQWMRLSCERYPDSWAIDVVNEPLHAVPSYKNALGGDGATGWDWVITSFRLARQYCPRAKLLLNEYATELDASKRAKIKTIASLLKSRGLIDGVGLQAHFFTLDYMNASQMKAALDDYATLGVDIYISELDLKGSANTDASQKAKYEELFPVMWNHASVKGITLWGYKVGETWSSGTGLLNANGSERPALTWLKSYMSSRPAASSSSSSSVSSSKSSSSSSSQSSASSSAGSAPVLSGTSDYPSGFSKCADLGGTCSVSSGTGWAAFGRKGKWVAKYVGVGKSIPCTVAAFGRDPGGNPNKCSFQR

SEQ ID NO: 81 - DNA, 1017 bp, Unknown
  Obtained from an environmental sample
ttgaccacgagagctattcgcacggaggcagcgctgaaggagatgtttgcggaggactttcagatcggagccgctgttaatccgatgactatacggacacaggaggagctgcttgcttatcacttcaacagtattacggcagagaatgaaatgaagtttgccagtctgcagccggaggagggggcttatgcttttgacgaggcggatcgattggcggccttcgcccggaagcatggcatggcgatgcggggacacactttagtgtggcataaccagtccacaggctggctgttcgaagacaagcagggaaatcctgtagataaggcaactctgctggagaggctgaaatcgcacatccatacggtagtaggacgttataaaaacgatatttatgcttgggatgtggtaaacgaggttatagaggacgagggagacggcctgctgcgccggtcgaaatggctggatattgccggaccggaattcattgcccgggcgttcgagtatgctcatgaggctgaccctaatgcgctgctcttctataatgactacaacgagtccaatccggcgaagcgagacaagatccatgctctggtgaagtcgctgctggagcaaggcgtgcctattcatggcattggactgcaggcgcattggaatttgtatggtccttctctcggcgagatccgagcggcactggagaagtatgcttctcttggcctgcagctgcagcttacggagctggatatgtcgctgtttcgttttgacgacaagcgtacggatataaccgagcctccggcggaattgcttgagctgcaggctgagcggtatgaggaaattttcaagctgctgagggaataccgggatgtaatcacttccgtgaccttctggggggctgcggatgattatacgtggctgaacgattttcccgtccgggggcggaaaaattggcctttcctgttcgatgagcagcatcaccccaaactggcatttcatcgggtcgctgcactttcccgccagtga

SEQ ID NO: 82 - protein, 338 aa, Unknown
  Obtained from an environmental sample
LTTRAIRTEAALKEMFAEDFQIGAAVNPMTIRTQEELLAYHFNSITAENEMKFASLQPEEGAYAFDEADRLAAFARKHGMAMRGHTLVWHNQSTGWLFEDKQGNPVDKATLLERLKSHIHTVVGRYKNDIYAWDVVNEVIEDEGDGLLRRSKWLDIAGPEFIARAFEYAHEADPNALLFYNDYNESNPAKRDKIHALVKSLLEQGVPIHGIGLQAHWNLYGPSLGEIRAALEKYASLGLQLQLTELDMSLFRFDDKRTDITEPPAELLELQAERYEEIFKLLREYRDVITSVTFWGAADDYTWLNDFPVRGRKNWPFLFDEQHHPKLAFHRVAALSRQ

SEQ ID NO: 83 - DNA, 3024 bp, Unknown
  Obtained from an environmental sample
atgaaaaccaaaaggtctatattcaggttgtctatcctggttgtcctggctgtgctgctgttcagcgcaatcaccttgacagccagcgccgccgacacgctcggcgcggcggcggcccagtcgggccggtacttcggcacggcgatagctgccggcaagctcggcgactcgacctacacgaccattgccaaccgtgagttcaacatgatcacggctgagaatgagatgaagatcgacgccaccgagccgaaccagaaccaattcaacttcaccaacgccgaccggatcttcaactgggcggtgcagaatgggaagcaggtgcgcgggcacacgctggcatggcactcgcagcagccggggtggatgagcagcatgagcggcaccgcgctgcgcaatgcgatgatcaaccacatcaatggggtgatggcccactacaagggcaggatctacgcctgggatgtggtgaacgaggctttcaacgaggacggcagccgccgcaactcgaacctgcagcagaccggcaacgactggatcgaggtggccttccggacagcccgcaccgccgacccggccgccaagctgtgctacaacgactacaacatcgaagcctggagctatgccaagacgcagggcgtttaccggatggtccaggacttcaagtcccgcggcgtgccgatcgactgtgtcgggttccagagccacttcaacagcggcacttcctacgtcaacagcaacttccggacgacgctgcaaagcttcgccgcgctgggcgtggacgtgcagatcaccgagctggatgtcgagaatgccgactcgcggctcgattggtggagaggcatcgtcaatgactgcctggcggtcccgcgctgcaacggcatcacggtgtggggcgtgcgcgacagcgattcgtggcgctcttcgcagaacccgctgctgttcaactccagcggtggtaagaaggcttcgtacaccgccgtcctcgacgccctcaacgctgccccgaccgtcacacctccggtaacgacacctccggtgacgacaccgccagtgaccacgcctcctcccggcactgtgtcgattaacgcgggcggctcggcgagcggcagcttcacggccgaccagtacttcagcggtggcagcacctacaccaacaccgccaccatcgacatgagtcagatcaccagcaacccaccgccggcggcggtcttcaacagcgagcgttacggggcgatgacctacaccatccccaaccgctcgggtgctcagacggtgacgctgtactttgccgagacctacctcaccgcggcagggcagcggtcgttcaacgtgtcgattaatggcgcagcggcgctgtccaacttcgacatctatgcctcggcaggtggcgctaaccgggccatcgcccggacgttcagcaccacggctaactcaagtggccaggtggtgatccagttcacggcggttaccgagaaccccaagatcaacgctatcacggtaacagcgggtggcacgcctccaccgacaacgcctccgcccaccacgccgccaccgaccacccctccggtgacgacacccccagtgacgacacccccagtgacgacaccgccccccggcagcgtgtcgatcaacgcgggcggctcggccaccggcagcttcacgggcgaccagtactttagcggtggcagcacctacaccaacaccgccaccatcgacatgagccagatcaccagcaacccaccaccggcggcggtgttcaacagcgagcgctacggggcgatgacctacaccatccccggccgctcgggggctcagacggtcacgctttactttgccgaaacgtatgtcactgcggcagggcagcgcgtctttaacgtgtctgtaaacggcgcggcagcgctgtccaacttcgacatctatgccagcgccggcggccagaaccgggccatcgctcgctccttcaacaccacggccaactcaagcggccaggtggtgatccagttcacggcggtcaccgagaaccccaagatcaacgccatcactgtggcgggcgggatcggggacttccaaaccctgaccgtcacgaagtccggcacggggacggtcacctccaacccggctggtatcaactgcggctcgacctgcaacgccagcttcgctaccggcaccagcgtgaccctgaccgcctccggcgggaccttcaccggctggagcggagcctgctccggcacctccaccacctgcaccgtctccatgacccaggcccggtcggtcaccgctacttttagcggcggtggtgacaccaggccgagcgcggggtgtggtaagaaccggacactgcagaatggcacaatcaccatttcaagtggcggcgtcaaccgcacctacatcctacgcacgcctgacaactacaacaacacgcatgcataccggctgatcatggcttatcactggcttaacggcagcgcgcagaatgtggcgagcgagaactactaccggctgttcccactctccaacaacagcaccatcttcgtggcgcctcaggggctggatgccggatgggctaacaccaacaaccgcgacctgaacctcaccgatgccatactcacccaggtcgagaacgatctgtgcgtcgacttgaaccgggtctgggccaccgggttcagctacggcgcaggtatgtcatacgccatcgcctgtgccagggccaatgtgttccggggcgtcgctctctatgccggcgcgcagctcagcggttgcaccggtggaaccacggccattgcgtacttcgcaacgcacggcatcaacgacagtgtcctcaacatctcgcaagggcggactctacgcgaccgctttgtctcgaacaacagctgcacggcgcagaaccctcccgagccttcctcgggcagcgggacgcacatctgcacgtcctaccagaactgctcggcaggacatcctgtccggtggtgcgcgttcgacggcgaccacaccccgaatcagaccgaccgcggccagagcacaagctaa

SEQ ID NO: 84 - protein, 1007 aa, Unknown
  Obtained from an environmental sample
  SIGNAL (1)...(30)
MKTKRSIFRLSILVVLAVLLFSAITLTASAADTLGAAAAQSGRYFGTAIAAGKLGDSTYTTIANREFNMITAENEMKIDATEPNQNQFNFTNADRIFNWAVQNGKQVRGHTLAWHSQQPGWMSSMSGTALRNAMINHINGVMAHYKGRIYAWDVVNEAFNEDGSRRNSNLQQTGNDWIEVAFRTARTADPAAKLCYNDYNIEAWSYAKTQGVYRMVQDFKSRGVPIDCVGFQSHFNSGTSYVNSNFRTTLQSFAALGVDVQITELDVENADSRLDWWRGIVNDCLAVPRCNGITVWGVRDSDSWRSSQNPLLFNSSGGKKASYTAVLDALNAAPTVTPPVTTPPVTTPPVTTPPPGTVSINAGGSASGSFTADQYFSGGSTYTNTATIDMSQITSNPPPAAVFNSERYGAMTYTIPNRSGAQTVTLYFAETYLTAAGQRSFNVSINGAAALSNFDIYASAGGANRAIARTFSTTANSSGQVVIQFTAVTENPKINAITVTAGGTPPPTTPPPTTPPPTTPPVTTPPVTTPPVTTPPPGSVSINAGGSATGSFTGDQYFSGGSTYTNTATIDMSQITSNPPPAAVFNSERYGAMTYTIPGRSGAQTVTLYFAETYVTAAGQRVFNVSVNGAAALSNFDIYASAGGQNRAIARSFNTTANSSGQVVIQFTAVTENPKINAITVAGGIGDFQTLTVTKSGTGTVTSNPAGINCGSTCNASFATGTSVTLTASGGTFTGWSGACSGTSTTCTVSMTQARSVTATFSGGGDTRPSAGCGKNRTLQNGTITISSGGVNRTYILRTPDNYNNTHAYRLIMAYHWLNGSAQNVASENYYRLFPLSNNSTIFVAPQGLDAGWANTNNRDLNLTDAILTQVENDLCVDLNRVWATGFSYGAGMSYAIACARANVFRGVALYAGAQLSGCTGGTTAIAYFATHGINDSVLNISQGRTLRDRFVSNNSCTAQNPPEPSSGSGTHICTSYQNCSAGHPVRWCAFDGDHTPNQTDRGQSTS

SEQ ID NO: 85 - DNA, 1254 bp, Bacteria
atgaccttgattacgccaagctcgaaattaaccctcactaaagggaacaaaagctggagctcgcgcgcctgcaggtcgacactagtggatctcacactttacttcgagtctcagaatccgaccctcgagttctacgtggacgatgtgaaggtagtggacaccacctctgctgagataaaactcgagatgaatccagaagaggaaataccagccctcagggaagttctgaaagactacttcagagtgggcgttgctcttccatccaaggtattcatcaaccagaaggacttaacgctcatcaccaagcacttcaacagcatcaccgcagaaaatgagatgaaacctgatagtctgcttgcaggcattgagaatggcaaactcaagttcagatttgaaacagcagacaaatacatcgaatttgcacagcaaaacggcatggttgtgaggggccacacactggtatggcacaatcagacgcccgagtggttcttcaaagacgaaaatggaaacctcctctccaaagaagcgatgacagaaagactcagagaatacatacacaccgtcgttggacacttcaaagggaaggtctacgcatgggacgttgtgaacgaagcggtcgatccgaaccagccagatggactgagaagatccacctggtatcagatcatggggcctgactacatagaacttgccttcaagtttgcaagggaggcagatcccgatgcgaaactcttctacaacgactacaacaccttcgaacccaaaaagagagacatcatctacaaccttgtgaagagtctcaaggaaaagggtctcatcgatggaatcggtatgcagtgtcacatcagtcttgcaacggacatcaggcagatcgaagaggccatcaaaaagttcagctccatccctggtatagaaatccacataacagagctcgatatgagcgtctacagagattctacttccaactacccagaggcaccgaggaacgcactcattgaacaggctcacaagatggctcaactctttgaaatcttcaagaaatacagtaatgtgatcacaaacgtcacgttctggggtctcaaagacgactactcctggagagcaacaagaagaaatgactggacattgatctttgacaaagattatcaggcaaaactcgcttactgggcgattgtcgctcctgaagtgctaccacctctttcaaaagaaagcaagatccaaagaattcaaaaagcttctcgagagtacttctag

SEQ ID NO: 86 - protein, 417 aa, Bacteria
MTLITPSSKLTLTKGNKSWSSRACRSTLVDLTLYFESQNPTLEFYVDDVKVVDTTSAEIKLEMNPEEEIPALREVLKDYFRVGVALPSKVFINQKDLTLITKHFNSITAENEMKPDSLLAGIENGKLKFRFETADKYIEFAQQNGMVVRGHTLVWHNQTPEWFFKDENGNLLSKEAMTERLREYIHTVVGHFKGKVYAWDVVNEAVDPNQPDGLRRSTWYQIMGPDYIELAFKFAREADPDAKLFYNDYNTFEPKKRDIIYNLVKSLKEKGLIDGIGMQCHISLATDIRQIEEAIKKFSSIPGIEIHITELDMSVYRDSTSNYPEAPRNALIEQAHKMAQLFEIFKKYSNVITNVTFWGLKDDYSWRATRRNDWTLIFDKDYQAKLAYWAIVAPEVLPPLSKESKIQRIQKASREYF

SEQ ID NO: 87 - DNA, 1089 bp, Unknown
  Obtained from an environmental sample
ttgaagaacagaattaaaaaggttgtgggcgggctcgccctggcgagtgttctgctcacctcggtaatggcaggcaatgccagcgcagcaattaccaatggatcgaagttcctggggaatatcattgccggcagtgctccaagtaacttcaccacctactggaatcaggtcaccccggagaacggcaccaaatggggttccatcgaaggcaaccgcaaccagatgaactggggaaacgcggacatgatctataactacgccatcagcaaaaacatcccgttcaaattccatactctcgtctggggaagccaggagcccaactgggtggccggcttgtcggcagcggagcagaaggcggaaatcagctcattcattactcaagcaggacagcgttattccgcgaagacagcttttgtggatgtagtcaatgaaccgctgcatgccaagccttcgtaccgcaatgccatcggcggcgatggcagcaccggctgggattgggtgatctggtctttccagcaagcccgggccgccttcccgaacgccaagctgcacctcaatgactacggcattatcggtgaccccagcgcggccgataaatatgtgaacattatcaatatcctgaaatccagaggactgatcgatggtattggtattcagtgccactacttcaatatggataacgtaagtgtgagcaccatgaatactgtactgggtaagcttgctgcaacaggcctgccaatctatgtctccgagctggatattaccggtgatgacaacacccagcttgccagataccaacagaaattccctgtgctctggaaccatccttccgtgaagggcgtcaccctgtggggctacatccaaaatcagacctgggcatcaggcacccatctggtgaattccaacggcacagagcgccctgccctgaagtggctgaagcaatacctgggcggctcgtcagctctgatggaaaccacagacgcccaagacctcactatcactgacagtctgatccagccggacagtgtggttgagccggaccctcaactggatctccagccggtgcttgagcccgttccggctgagtaa

SEQ ID NO: 88 - protein, 362 aa, Unknown
  Obtained from an environmental sample
  SIGNAL (1)...(29)
LKNRIKKVVGGLALASVLLTSVMAGNASAAITNGSKFLGNIIAGSAPSNFTTYWNQVTPENGTKWGSIEGNRNQMNWGNADMIYNYAISKNIPFKFHTLVWGSQEPNWVAGLSAAEQKAEISSFITQAGQRYSAKTAFVDVVNEPLHAKPSYRNAIGGDGSTGWDWVIWSFQQARAAFPNAKLHLNDYGIIGDPSAADKYVNIINILKSRGLIDGIGIQCHYFNMDNVSVSTMNTVLGKLAATGLPIYVSELDITGDDNTQLARYQQKFPVLWNHPSVKGVTLWGYIQNQTWASGTHLVNSNGTERPALKWLKQYLGGSSALMETTDAQDLTITDSLIQPDSVVEPDPQLDLQPVLEPVPAE

SEQ ID NO: 89 - DNA, 2541 bp, Bacteria
atggatacattgttcaatacaaccgatgagcgtggggcgtccaagcgccgtggcatcgtcgcggcgcttgcggccgcagccatgctggtgccgctggcgttcgccccgacggccatggcggccgaccccgactatccgggcggcatcaagggcgaatacaatccgctgggaatcaacgctggtgtcgccatcgagacatacaccctcaaccaggacaaggagaaggccctggtcgagaacttcgaccagatcaccccggagaactcgctgaagccggaaggctggtacgacgaccagcataatttccgcatgtcggatgacgcgcggaacctgctgacgttcgccagcgagaacggcatcaaggtctacggccatgttctggtctggcactcgcagacgcccgactggttcttccaggccgacgaatggtgccatgacaccaacgacaaccccggcgtcaccagctgcccgcttgccgacaaggccacgatgcaggaacgccagcgcaggcacatcgagaacgtggcggaggccatctccgacgaattcggaaaattcggcagcccgaccaatcccgtcgtcgcgttcgacgtggtcaacgagaccgtgaacgacagcgacgaccccgccaccaacggcatgcgcaattcgctgtggtatcagacctatgggggcgaggactacatctatgacgcgttccggaacgcgaatacgtatctgaacgacgtctacgccgccgacgacgcggagcatccggtgacgttgttcatcaacgattacggcaccgagcaggcgggcaagcgttcccgctacaaggcgcttctggaacgcatgatccagcagggggttccctttgacggcatcggtcaccagttccatgtgtcgttgaccacggcctcgtcgaatctcgacgacgcgctgaccgatatgtcctcgctcggcaagaagcaggccatcaccgaactggacgtcgccaccggaacgccggttacggaggcgaagctcatcgagcagggacggtactactacgacgtcaaccagatcatccacaggcacgccgaccagctgttctcggtttcggtgtgggggctgagcgacgaccagtcctggcgcaacaaggagggcgcgccgctgctgttcgacgacaacctggagaagaagccggcgtacatcggctacatcggtgatagcgccaaccttcccgagccgttgaagagcatgaacgcattcaaggatgacgccgtgggcatcgactcggcgcttcccggtaccgtggccgagtccggcgcgtcctctccgtgggaacgtctttcgctggtcgagatgaccccgtctgcgtatgacgccgtttccggctcgttcaatgtctattggaaggacggctctctggtcgtctacgcggatgtcgccgatgccagcgcggcggatgacgacaccgtcaccgtgcgtgtgggtgacgccgagtatacgatcggccgcaacggtgtgaccggcggcgagggtgtgcaggccaacgtcgtttcgtctgatgccggatacgaagtcgtggccgatatcccgtacaccggtgcagagaaggacatcgtcgagatgaacgtcatcgcgacggattccgccaccacggagaccagcgcgtggagcacgaacgacactggcgccgtcacgctggccgagccgctgagctacacggaagccgtgaaggttcccgccgacgcccaggctccggtcgttgacgccgacccgtcggattccgtctgggcggaagccaacgaggttcccgtgggtaaggtgaccgccgccacgccttcccccgaggcgaccgctaccgccaagaccctgtggtcggacggcaagctgtatgtcctcatggaagtgaccgacgcggacatcgatctgaccaactcgaatccgtgggagaaggactccgttgaggtgtacatcgaccgtggcaacaccaagagcggccagtataccaacgacatccagcagattcgcgtgtccgccgatggtgcggagctgagcttcggctccggcgcgtcggaggatgtccagaagtccatggtccagaccgccggcaagctcgtcgatggcggctatgtcgtcgagatggccatcgatctgggaacggctgaggccggcaccttcgaaggtgtcgacttccagatcaacgacgcgaagaacggtgctcgaatcggcatccgcaactgggccgatccgaccggtgccggctatcagacggcgtcccattggggcgtgctgcgtctgctggccgatccctccgaaaccgagaccccgggtggagaagatcccgagacccccggtgacgaggagactcctggcgaggataccgagaagcctggcgacgaggaaacccccggtgaggataccgagaagcctggcgacgagaagccgcggccttccgacgatgctgacaacgacgacaagatgccgcagaccggttccgcggtcatcggaatcgccgtggtggcgctgctgctggttgccgccggatgcgggctggtcatcgctcggcgtcgatga

SEQ ID NO: 90 - protein, 846 aa, Bacteria
  SIGNAL (1)...(40)
MDTLFNTTDERGASKRRGIVAALAAAAMLVPLAFAPTAMAADPDYPGGIKGEYNPLGINAGVAIETYTLNQDKEKALVENFDQITPENSLKPEGWYDDQHNFRMSDDARNLLTFASENGIKVYGHVLVWHSQTPDWFFQADEWCHDTNDNPGVTSCPLADKATMQERQRRHIENVAEAISDEFGKFGSPTNPVVAFDVVNETVNDSDDPATNGMRNSLWYQTYGGEDYIYDAFRNANTYLNDVYAADDAEHPVTLFINDYGTEQAGKRSRYKALLERMIQQGVPFDGIGHQFHVSLTTASSNLDDALTDMSSLGKKQAITELDVATGTPVTEAKLIEQGRYYYDVNQIIHRHADQLFSVSVWGLSDDQSWRNKEGAPLLFDDNLEKKPAYIGYIGDSANLPEPLKSMNAFKDDAVGIDSALPGTVAESGASSPWERLSLVEMTPSAYDAVSGSFNVYWKDGSLVVYADVADASAADDDTVTVRVGDAEYTIGRNGVTGGEGVQANVVSSDAGYEVVADIPYTGAEKDIVEMNVIATDSATTETSAWSTNDTGAVTLAEPLSYTEAVKVPADAQAPVVDADPSDSVWAEANEVPVGKVTAATPSPEATATAKTLWSDGKLYVLMEVTDADIDLTNSNPWEKDSVEVYIDRGNTKSGQYTNDIQQIRVSADGAELSFGSGASEDVQKSMVQTAGKLVDGGYVVEMAIDLGTAEAGTFEGVDFQINDAKNGARIGIRNWADPTGAGYQTASHWGVLRLLADPSETETPGGEDPETPGDEETPGEDTEKPGDEETPGEDTEKPGDEKPRPSDDADNDDKMPQTGSAVIGIAVVALLLVAAGCGLVIARRR

SEQ ID NO: 91 - DNA, 1023 bp, Unknown
  Obtained from an environmental sample
atgaatgtatcggtaccggccgagtccgcacttaaagacatcttcgcggaagacttccatataggtgcggcggtcagtagtaatacgatcaagtcgcaggagagtctgcttacgcatcactttaacagcattacggcggaaaacgaaatgaagttcgccagcgtccatccagaggaagagctttacaccttcgaggaagcggatcagatcgtggacttcgcgcgcaaacacgggatggctgtccgcggacatacgctggtatggcataaccagaccaccgattggttgttccgcgacaagcagaatcagctcgtgagcaaagccgtgctttatgaaagaatccgttcgcatatccaaacggtagtaggcagatataagggcgatatttacgcttgggacgttgtgaacgaggtcattgccgatgacggcgatcagttgctgcgtacctccagctggacggaaatcgccggggacgaattcatcgccaaagcgtttgaatacgcgcatgctgccgacccgaatgcgctgttgttctacaacgactacaatgagtcccatccaagcaaacgggataaaatttataccttggtcaagtctcttctggaccggggagtacctattcacggcattggcctgcaggcacactggaatctgttcaacccgtccttggatgacatccgggcagccatcgaaaaatatgcttcgctaggattgcagctccagctcacggaactggatgtgtcggtattccgtttcgaagataagcgggccgatctgaccgagcctgaaccgggaatgctggaacagcaggctgaattctacgaagccgtgttcaagctgcttaaggaatacagcgatgtaattagcgcggtgacgttctggggagctgcggacgaccacacctggctcagcgattttccggtacgtgggcgcaaaaactggccgctgctgttcgatgagcggcacaggccgaagccggcatattatcgcttagctgctcttgccaatcatcttcggcgttga

SEQ ID NO: 92 - protein, 340 aa, Unknown
  Obtained from an environmental sample
MNVSVPAESALKDIFAEDFHIGAAVSSNTIKSQESLLTHHFNSITAENEMKFASVHPEEELYTFEEADQIVDFARKHGMAVRGHTLVWHNQTTDWLFRDKQNQLVSKAVLYERIRSHIQTVVGRYKGDIYAWDVVNEVIADDGDQLLRTSSWTEIAGDEFIAKAFEYAHAADPNALLFYNDYNESHPSKRDKIYTLVKSLLDRGVPIHGIGLQAHWNLFNPSLDDIRAAIEKYASLGLQLQLTELDVSVFRFEDKRADLTEPEPGMLEQQAEFYEAVFKLLKEYSDVISAVTFWGAADDHTWLSDFPVRGRKNWPLLFDERHRPKPAYYRLAALANHLRR

SEQ ID NO: 93 - DNA, 1011 bp, Unknown
  Obtained from an environmental sample
atgaatcaatcagtaaatgaagcacaggttcctgcattatcggatgtatatgaagattatttttcaataggtgccgctgttaatccacttactttaggtacgcaaaaaaagctgttaaccaaacattttaatagtataacggctgagaatgaaatgaaatttgaagcattacagcctaaaccagatcaatttacatttgatacggcggataaaatggttgcctttgcccaagcacatgatatgaagatgcgtggccatacattaatctggcacaatcaaacaccagattggatgtttttgcaaaaagacggtacgacaattgatcgtgaaacactcttggagagaatgaaaaaacatattaagacggtggtggaaagatataaaggcaaaatatattgttgggacgttgtaaatgaagcggtagctgatgaaggcgaagctattttaagaccatcaaaatggacggacattattggcgactcgtttattgagtatgcttttaaatacgcccacgaggccgatcccgatgcactgttgttttacaatgactacaatgcttgccaccctcataaaagagataagatttatcaacttgtaaaggggttaatagacaagggtgtgcccatacacggtattggcctacaagcacattggaacattgttgacccgtcttacgatgatattaaacgagccatcgaaacttatgcatcattaggattaagcatacactttactgaaatggatgtgtctgtttttgaatatcatgatcgaagaacagacttattggaacctacaaaagatatggtttcacgtcaagctgagcgttatcaggcattttttgaaatatttaggtcgtatgctgatgtgattgattccgttacgttttggggcatggccgatgattatacatggcttgatgattttccggtgacaggtcgaaaaaattggccctttgtatttgatgcgagacatcagcctaaaacagcattctggaacatcgttgatttttaa

SEQ ID NO: 94 - protein, 336 aa, Unknown
  Obtained from an environmental sample
MNQSVNEAQVPALSDVYEDYFSIGAAVNPLTLGTQKKLLTKHFNSITAENEMKFEALQPKPDQFTFDTADKMVAFAQAHDMKMRGHTLIWHNQTPDWMFLQKDGTTIDRETLLERMKKHIKTVVERYKGKIYCWDVVNEAVADEGEAILRPSKWTDIIGDSFIEYAFKYAHEADPDALLFYNDYNACHPHKRDKIYQLVKGLIDKGVPIHGIGLQAHWNIVDPSYDDIKRAIETYASLGLSIHFTEMDVSVFEYHDRRTDLLEPTKDMVSRQAERYQAFFEIFRSYADVIDSVTFWGMADDYTWLDDFPVTGRKNWPFVFDARHQPKTAFWNIVDF

SEQ ID NO: 95 - DNA, 1143 bp, Unknown
  Obtained from an environmental sample
atgaaaaaaacgattgcacatttcaccttatggatagtgttttttctcttcacttcctgtgctgttacggcgcagaagaatgctaagaatacaagagtaaaactcactaccctaaaagaggcttaccaaggtaaattctatatcggtactgcgatgaatctgagacagattcacggagatgatccccagtctgaaaatattatcaaaaaacagttcaattccatagttgccgaaaactgcatgaagagtatgtatcttcagccggaggaaggaaaatttttcttcgatgatgcggacaagtttgtggattttggtcttcagaacaatatgttcatcatcgggcattgtctgatttggcattcgcaggcgccaaaatggtttttcaccgatgagaatggaaaaacggtttccccagaagttcttaaacaaaggatgaaagcccatatcaccgctgtcgtttcccgctacaaagggaaaatcaaaggttgggatgtggtgaacgaagccattatggaagatggttcttaccgcaaaagcaaattttatgagattttgggagaagaatttattccgttggcatttcagtatgcgcatgaagcagatcctgatgcagaactttattacaacgattataacgaatggtatcccggaaaaagagctacggtgaccaagataatccgcgatttcaaatctagaggaatccgcattgatgccatcggaatgcaggctcatttcgggatggattcgcccactttagaagagtatgaacaaaccattcagggctatataaaagaaggcgtgaaagtcaatattacggaactcgatttgagtccgcttccttctccttggggaacttccgccaatgttgccgatacgcagcagtatcaggaaaaaatgaatccttacaccaaaggacttcccgccgatgtggaaaaagcatgggaaaaccgctatctcgattttttcaaactgttcctgaaatatcatcagcatatcgagcgtgttacgttttggggcgttagcgatatcgattcctggaagaacgattttccagtaagaggacgtaccgattatccactaccgtttaaccgacagtatcaggcaaaacctttggtgcagaaattaatagacttaacgaaatag

SEQ ID NO: 96 - protein, 380 aa, Unknown
  Obtained from an environmental sample
  SIGNAL (1)...(24)
MKKTIAHFTLWIVFFLFTSCAVTAQKNAKNTRVKLTTLKEAYQGKFYIGTAMNLRQIHGDDPQSENIIKKQFNSIVAENCMKSMYLQPEEGKFFFDDADKFVDFGLQNNMFIIGHCLIWHSQAPKWFFTDENGKTVSPEVLKQRMKAHITAVVSRYKGKIKGWDVVNEAIMEDGSYRKSKFYEILGEEFIPLAFQYAHEADPDAELYYNDYNEWYPGKRATVTKIIRDFKSRGIRIDAIGMQAHFGMDSPTLEEYEQTIQGYIKEGVKVNITELDLSPLPSPWGTSANVADTQQYQEKMNPYTKGLPADVEKAWENRYLDFFKLFLKYHQHIERVTFWGVSDIDSWKNDFPVRGRTDYPLPFNRQYQAKPLVQKLIDLTK

SEQ ID NO: 97 - DNA, 1407 bp, Unknown
  Obtained from an environmental sample
atgaatgaaacctcgcggaattggttggagagaggattgcctttcgaacgccaacggcgttccaacattcagcccagggttggcgcttgcgcctaccctgggttggaagcaatcgctccatcaaccctgaaagggttgcagcggaggtttgcacaagaccgatacaaccctttcaggattggctttctcccttttccacccagggtagcgcctgcggcgcaaccctgggctgatggatcagaacgccgttggcgttcccggaaacctgcgaagaaacaactcgccttcctggccatcaccagtctcctctcgggtctgctgtggggcgccgaagtgcaaccggcactgaaagacgtattccgccaggacttcctgctgggggcggcgttgaacgcggagcaggtgctggacaccaaccgggtcgagtcggtattgatcgaaaagcatttcaacacgatcacgcccgagaatgtgctgaagtgggaacgagtccatcctcagcccaaccagtattcttttgaggacgcggatcgctacgtcgagttcggccgcaaacacggaatggtcatcatcggccacacgctggtctggcacagccagacgcccggctgggtcttccgggatgccgacggaaagacgctgacgcgcgaagccctgctggagcggatgcgcgaccacatccacaccgtggtcgggcgctacaagggcaagatccgcggctgggatgtggtgaacgaggcgctgcgcgacgacggcgcgtggcggaattcccaatggcggcggatcatcggcgacgattacattttgaaagccttccagtatgcccatgaggccgatccggatgcggagctctattacaacgattattcgctggagaagccggccaagcgcaatggcgccgtggacctggtgaagcagctccaggccggcggggcgaagctggccggcgtcggcttgcaggggcactacaacctcgactggccggagaccgccgagatcgaaaacaccatcgcggcgttcgcggagctggggctcaaggtgatgatcacggagctggacgtcaacgcgctgccgacgcccggccagtcgggcgaagccgatgtagggatgacgttcggcggcaatttcggcggcgataaatggaatcctttcacgaacggactgccggccgcagtggagcaacgcctcgcggaccgctacgctgaaatcttcaggatcttcacgaagcacagccgtcggatttcgcgcgtcaccttctggggcgtcaccgaccggacctcctggctcaacaattttcccatccgcggccggaccaattacccgttgctctttgatcgggctggggagcccaaacccgcgttccgatccgtcgtggcggtccgtcagccgcgccagcccgtcgaatga

SEQ ID NO: 98 - protein, 468 aa, Unknown
  Obtained from an environmental sample
MNETSRNWLERGLPFERQRRSNIQPRVGACAYPGLEAIAPSTLKGLQRRFAQDRYNPFRIGFLPFPPRVAPAAQPWADGSERRWRSRKPAKKQLAFLAITSLLSGLLWGAEVQPALKDVFRQDFLLGAALNAEQVLDTNRVESVLIEKHFNTITPENVLKWERVHPQPNQYSFEDADRYVEFGRKHGMVIIGHTLVWHSQTPGWVFRDADGKTLTREALLERMRDHIHTVVGRYKGKIRGWDVVNEALRDDGAWRNSQWRRIIGDDYILKAFQYAHEADPDAELYYNDYSLEKPAKRNGAVDLVKQLQAGGAKLAGVGLQGHYNLDWPETAEIENTIAAFAELGLKVMITELDVNALPTPGQSGEADVGMTFGGNFGGDKWNPFTNGLPAAVEQRLADRYAEIFRIFTKHSRRISRVTFWGVTDRTSWLNNFPIRGRTNYPLLFDRAGEPKPAFRSVVAVRQPRQPVE

SEQ ID NO: 99 - DNA, 1074 bp, Unknown
  Obtained from an environmental sample
gtgcgctcaagagctagcgcgtactggttcggcgtggggttggtggtggcgctgagcctggctcagaccccttccccccagtccctgcgcgcgctggccgagcgccaggggctgctggtgggagccgcggtggacctagcggccctgtacgaccccctcgagcccgagtacgcccaactcctcgcccgcgagttcaacctggtggtggccgagaacgccatgaagtgggcctccctgagcaacgcgcgggggcagtacagcttcaccggcgctgacgccctggtgcgcttcgcccgccagcacggccagcgcttgcgcggccacaccctcatctggcacgagcaactgcccgcgtgggtgcgcagcggcaccttctcccgcgaggccatgctggcggtgatgcaggagcacattcaggcggtggccgggcacttccgcggccaggtggcctactgggacgtggtcaacgaggcggtgagtgaccggggcggcctgcgcgagaccccctttctgcgggcggtgggccccgactacctcgagcacgccttccgcttcgcccgcgccgccgacccccaggccaagctcttctacaacgactacggcgccgacggcatgggcgctaaatcggacgagatctacgccctgctcaaagcgctcaaggccaagggggtacccgtcgacggggtgggcttccaggcccacctcgacagcaccttctcggtccagcaggcgcggatgcgggagaacctagagacgcttcgccgacctgggcctcgaggtgcacatcaccgagctggacgtgcagctaaaaggggcgggctcgcgggaggaacggctggaggcgcaggcccggatctacgccgaggtgctggcgacctgccgcgcggtccgcggctgcagcgccgtgacgctgtggggcttcaccgacgcccactcctggcgagccgccgccgaacccctgatcttcgacgcgctctaccggcccaaaccggcgtaccaggctctgctgcgggctctgggaggcaacccttgagccttttcagcccagttttgccaacgaggacagcactatga

SEQ ID NO: 100 - protein, 357 aa, Unknown
  Obtained from an environmental sample
  SIGNAL (1)...(33)
VRSRASAYWFGVGLVVALSLAQTPSPQSLRALAERQGLLVGAAVDLAALYDPLEPEYAQLLAREFNLVVAENAMKWASLSNARGQYSFTGADALVRFARQHGQRLRGHTLIWHEQLPAWVRSGTFSREAMLAVMQEHIQAVAGHFRGQVAYWDVVNEAVSDRGGLRETPFLRAVGPDYLEHAFRFARAADPQAKLFYNDYGADGMGAKSDEIYALLKALKAKGVPVDGVGFQAHLDSTFSVQQARMRENLETLRRPGPRGAHHRAGRAAKRGGLAGGTAGGAGPDLRRGAGDLPRGPRLQRRDAVGLHRRPLLASRRRTPDLRRALPAQTGVPGSAAGSGRQPLSLFSPVLPTRTAL

SEQ ID NO: 101 - DNA, 1131 bp, Unknown
  Obtained from an environmental sample
atgaagtattggcttacaaccctggttttaatgatagcgggaatacccttggcttttggttcttcagcaaagcaagataaatcaaagagtttgaaagatgctttcaaaaacaaattctatatcggtgtggctttgaaccggagtcaatatctggaacaaaacgaacaggcggataaagagataaaggcacagttcagctctattgtagctgagaactgcatgaaaagcgaaaatctggaacctaaagagggaaaattcttctttgacgatgccgatcgttttgtcgcttttggagaaaaaaatggaatgtacatcattggacataccttaatttggcattctcaagtgccaaaatggtttttcatagataatgaaggcaaagttgtttcccgggaagttttgattgaacgaatgaaaaactacatccatacagttgtcggtcattataaaggtcgagttaaaggttgggatgttgtcaatgaggccattctagatgatggctcatttagacaaagtaatttctttaaaatactaggagccgattttattaaacttgcttttcaatttgcccatgaagcagatcccaatgctgagctttattacaacgattattcgatgtccaatccgaccaaaagagacggagtggttcgcatggtgaagtcattgcagcaacaaggtgtgagaatagacgctatcggaatgcagggacacgtagggatggattatcccaagttggatgagtttgaaaatagtatcaaagctttttcgtctttaggaaccaaagtgatgattacggaactcgatttaagtgtcctaccaactcctaaaggaaaacaaggtgctaatatttcggatgttgccgcttatgaggaaaagataaatccttacaaaaatggtctgccggctgaagttgaaaaggcttgggaagaccggtatttggattttttcaaattatttttgaaatatcaacaccaaatttcaagggttacattatgggggcttagtgatcaggattcgtggaaaaatgatttcccagtcagagggagaacggattatcctttgcttttcgacagacaatacaaaccaaaacctgtagttcagaaaattattaaattagcattgaaaaaataa

SEQ ID NO: 102 - protein, 376 aa, Unknown
  Obtained from an environmental sample
  SIGNAL (1)...(23)
MKYWLTTLVLMIAGIPLAFGSSAKQDKSKSLKDAFKNKFYIGVALNRSQYLEQNEQADKEIKAQFSSIVAENCMKSENLEPKEGKFFFDDADRFVAFGEKNGMYIIGHTLIWHSQVPKWFFIDNEGKVVSREVLIERMKNYIHTVVGHYKGRVKGWDVVNEAILDDGSFRQSNFFKILGADFIKLAFQFAHEADPNAELYYNDYSMSNPTKRDGVVRMVKSLQQQGVRIDAIGMQGHVGMDYPKLDEFENSIKAFSSLGTKVMITELDLSVLPTPKGKQGANISDVAAYEEKINPYKNGLPAEVEKAWEDRYLDFFKLFLKYQHQISRVTLWGLSDQDSWKNDFPVRGRTDYPLLFDRQYKPKPVVQKIIKLALKK

SEQ ID NO: 103 - DNA, 1449 bp, Bacteria
  Obtained from an environmental sample
atgcgttcacattcccttcccccgtccaccgtccgccggaaattgggcggcctcggcgcggcgctgctcgtcggcgccgtcggcgccgccaccgtgctcgtggcgcccctcacctcgcacgccgccgagagcacgctcggcgccgcggcgaagcagagcggccggtacttcggcaccgccatcgcctcgggcaggctcaacgactcgacgtacacgacgatcgcgaaccgcgagttcaactcggtgaccgccgagaacgagatgaagatcgacgccaccgaaccccagcagggccgcttcgacttcaccgccggcgaccgcgtctacaactgggcggtgcagaacggcaagcaggtacggggccacaccctggcctggcactcccagcagcccgcctggatgcagaacctcagcggcagcgcgctgcgcacggcgatgaccaaccacatcaacggcgtcatggcccactacaagggcaagatcggccagtgggacgtcgtcaacgaggcgttcgcggacggcagttcgggagcgcgccgggactccaacctccagcggagcggcaacgactggatcgaggtcgccttccgcaccgcccgcgccgccgacccggccgccaagctctgctacaacgactacaacgtcgagaactggacgtgggccaagacccaggccatgtacgccatggtcaaggacttcaagcagcgcggcgtgcccatcgactgcgtcggcttccagtcgcacttcaacaacgacagcccctacaacagcaacttccgcaccaccctccagagtttcgccgccctcggcgtcgacgtggccatcaccgaactcgacatccagggcgcctcgggcacgacctacgccaacgtgaccaacgactgcctggccgtcccgcgctgcctcggcatcaccgtctggggtgtccgcgacaccgactcctggcgagccgagcacactccgctgctcttcaacggcgacggcagcaagaagcccgcctactcctccgtcctcaacgccctcaactccgtctcccccaaccccaaccccactccgaccccctcccccggcgccgggccgatcaagggagtcgcctcgggccgctgcgtggacgtacccggagccggcaccgccgacggcacccaggtccagctgtgggactgcaacaaccgcaccaaccagcagtggaccctcaccgccgccggtgagctcagggtctacggcgacaagtgcctggacgccgccggcaccggcaacggcgccaaggtccagatctacagctgctggggcggcgacaaccagaagtggcgcctcaactccgacggttccatcgtcggtgtccagtccggcctctgcctcgacgccgctgccggcggcaccgccaacggcacgctgatccagctctactcctgctggaacagcggcaaccagcgctggacccgcacctga

SEQ ID NO: 104 - protein, 482 aa, Bacteria
  SIGNAL (1)...(41): Obtained from an environmental sample
MRSHSLPPSTVRRKLGGLGAALLVGAVGAATVLVAPLTSHAAESTLGAAAKQSGRYFGTAIASGRLNDSTYTTIANREFNSVTAENEMKIDATEPQQGRFDFTAGDRVYNWAVQNGKQVRGHTLAWHSQQPAWMQNLSGSALRTAMTNHINGVMAHYKGKIGQWDVVNEAFADGSSGARRDSNLQRSGNDWIEVAFRTARAADPAAKLCYNDYNVENWTWAKTQAMYAMVKDFKQRGVPIDCVGFQSHFNNDSPYNSNFRTTLQSFAALGVDVAITELDIQGASGTTYANVTNDCLAVPRCLGITVWGVRDTDSWRAEHTPLLFNGDGSKKPAYSSVLNALNSVSPNPNPTPTPSPGAGPIKGVASGRCVDVPGAGTADGTQVQLWDCNNRTNQQWTLTAAGELRVYGDKCLDAAGTGNGAKVQIYSCWGGDNQKWRLNSDGSIVGVQSGLCLDAAAGGTANGTLIQLYSCWNSGNQRWTRT

SEQ ID NO: 105 - DNA, 2793 bp, Unknown
  Obtained from an environmental sample
atgaagttcactttgatgccgctgctgtgcgggttcgccttgctgttgggttgcgcggtgcaggcaaccccagccgcttcgttacagcaggcttatcagccgtatttccatatcggtactgccgtcagcttggcgcaactgcaagcatcgaaaaaccatgaacgagatttaatcgcccagcactttaacagtctgaccgctgaaaacctgatgaaatgggaaaaaatccaaccgactgaaggcaactttgattttacagcggccgacaagctcgtcgcttttgctgaacaacatcggatgtggctggtcggccatacgatcctgtggcatgaacaaaccccggactgggtatttcaggggccagatggcaaaccggccagcaagcaagtgttactcggcagattaaaaaagcatatccaaactgtggtcggtcgttaccaaggtcgggtacatggctgggatgtagtgaatgaagcgctgaatgaagatggcagtctgcgcgatacgccgtggcgaaaaattctgggtgatgattacattgccaccacttttgcgctggtgcatcaggtcgaccccaaagccaaactctattacaacgactacaacctgtataaaccaaaaaaacgcactggcgtgctacggatcatccagcaactgcagcaacaacaagtgcccattcatgccattggcgaacaagcgcattatggtctcgattcgccgaaattgcaggaagttgaagactcgatcaacgcctttgcagccaccggcctcgacgtgatgctgaccgagttggaaatttcggtgctaccgtttccgcctggcatgacaccaggcgccgatatcagtcagcatcaggaactgcaacaacagctgaatccttaccgcgaaggcttaccaaaaaccgtcgaacaggcctggcaacaacgttatctggatctgttttcgctgttattgcgccagcatcaaaaattacaccgggtgacgttttggggtttagatgatggccaaagctggcgcaataactttccaatgcgcggtcgtaccgattacccgctactgtttgaccgcaagctgcaagccaaaccgctattgagcgcactgatcaaactggcagaaactcaagcctcagccaagccgaaagtaaatcagctcggttttgcgccaaatgcgcaaaaattgctggtggtgccggggcggcaggcggtgtcgtttcagatcatcaatcaaagcaacggcaaaacggtgttgcaaggccaaagttcggtggctcagttttggcccgaatcgggcgagtgggtcagtatcgctgacttttcgaccttaaccacccaagggcgttatcaggttgaagcggctggattaactccgatcaccgtcgagattactgctgaaccttatgccgcgctgcatgatgcgtccatcaaagcctattattttaatcgcgcctcgctggcgctggagccaagttttgccgggccttgggcgcgcgctgccggtcatccggataacaaagtgttggtgcacacttccgccgcttccgacaagcgaccagccggttttgtgatcagcgccgctaaaggctggtatgacgccggtgactataacaaatacgtggtcaattccggtatttccagttacaccctattgcaagcctggcaggattttcctgagttttatcgcgacagaacatggaatcttccggagtccagcaacaacctaccagacattctcgacgagacgttatggaatttacagtggctgagcaccatgcaggacccaagcgacggcggcgtgtatcacaagctgactgaactgaatttctctgctacccaaatgccgtcagaagtgacagcgccacgttatgtggtgcaaaaaaccacggcagcggcacttaatttcgcggcggtgctggccaaagccagtcgcatttttacagaatttgaaacgcaactgcccggcctgtcacagcaatatcgccagcaagcattagcagcctggcaatgggcgcaaaaaaatccacaacaaatttatcagcaaccagccgatgttcacaccggtgcttatggcgacaaacagctggctgatgaatgggcttgggctggggcggagctatatttattaaccggtgagcagagttacctgcagccgttgttggcacttgagacgccaatcaccgcagcttcctgggccaatgtggcggcgttgggttattttgcgttggcatccgctgaacagtttgagcctgcacttcgaaaaaaagtgcagcaaaaaatccaacaagccgcggcgcaaattgtagccgagcatcaagcgtccgcctaccaggtggcgatgactcaaaaagattttgtctggggcagtaatgcggtggcgatgaacaaaggcatgttgttatatcaagcgtggaaaattgacccacaaccagagctgcgacaggcgatgcaagggctgctggattacgtcctcggtcgcaacccgctgcagctgtcttatgtcacaggttttggtgcgcaaagcccgcaacatatccatcaccgcccctcggcggcagatcagatcaaagcaccagtgccgggctggttagtgggtggtgcacagccgggtaagcaagataaatgctcttattccggtatttttgctaccggcactttacccgctgccagcactttacctgcaacgacttatctcgaccactggtgcagctacgccaccaatgaagtggcgattaactggaatgcacctttagtgtacgtgctggcctggagcctttcaccagactccatgaccaaatga

SEQ ID NO: 106 - protein, 930 aa, Unknown
  Obtained from an environmental sample
  SIGNAL (1)...(22)
MKFTLMPLLCGFALLLGCAVQATPAASLQQAYQPYFHIGTAVSLAQLQASKNHERDLIAQHFNSLTAENLMKWEKIQPTEGNFDFTAADKLVAFAEQHRMWLVGHTILWHEQTPDWVFQGPDGKPASKQVLLGRLKKHIQTVVGRYQGRVHGWDVVNEALNEDGSLRDTPWRKILGDDYIATTFALVHQVDPKAKLYYNDYNLYKPKKRTGVLRIIQQLQQQQVPIHAIGEQAHYGLDSPKLQEVEDSINAFAATGLDVMLTELEISVLPFPPGMTPGADISQHQELQQQLNPYREGLPKTVEQAWQQRYLDLFSLLLRQHQKLHRVTFWGLDDGQSWRNNFPMRGRTDYPLLFDRKLQAKPLLSALIKLAETQASAKPKVNQLGFAPNAQKLLVVPGRQAVSFQIINQSNGKTVLQGQSSVAQFWPESGEWVSIADFSTLTTQGRYQVEAAGLTPITVEITAEPYAALHDASIKAYYFNRASLALEPSFAGPWARAAGHPDNKVLVHTSAASDKRPAGFVISAAKGWYDAGDYNKYVVNSGISSYTLLQAWQDFPEFYRDRTWNLPESSNNLPDILDETLWNLQWLSTMQDPSDGGVYHKLTELNFSATQMPSEVTAPRYVVQKTTAAALNFAAVLAKASRIFTEFETQLPGLSQQYRQQALAAWQWAQKNPQQIYQQPADVHTGAYGDKQLADEWAWAGAELYLLTGEQSYLQPLLALETPITAASWANVAALGYFALASAEQFEPALRKKVQQKIQQAAAQIVAEHQASAYQVAMTQKDFVWGSNAVAMNKGMLLYQAWKIDPQPELRQAMQGLLDYVLGRNPLQLSYVTGFGAQSPQHIHHRPSAADQIKAPVPGWLVGGAQPGKQDKCSYSGIFATGTLPAASTLPATTYLDHWCSYATNEVAINWNAPLVYVLAWSLSPDSMTK

SEQ ID NO: 107 - DNA, 1725 bp, Bacteria
gtgtggaagcccggattgtggaatttccttcaaatggcagatgaagccggattgacgagggatggaaacactccggttccgacacccagtccaaagccggctaacacacgtattgaagcggaagattatgacggtattaattcttcaagtattgagataataggtgttccacctgaaggaggcagaggaataggttatattaccagtggtgattatctggtatacaagagtatagactttggaaacggagcaacgtcgtttaaggccaaggttgcaaatgcaaatacttccaatattgaacttagattaaacggtccgaatggtactctcataggcacactctcggtaaaatccacaggagattggaatacatatgaggagcaaacttgcagcattagcaaagtcaccggaataaatgatttgtacttggtattcaaaggccctgtaaacatagactggttcacttttggcgttgaaagcagttccacaggtctgggggatttaaatggtgacggaaatattaactcgtcggaccttcaggcgttaaagaggcatttgctcggtatatcaccgcttacgggagaggctcttttaagagcggatgtaaataggagcggcaaagtggattctactgactattcagtgctgaaaagatatatactccgcattattacagagttccccggacaaggtgatgtacagacacccaatccgtctgttactccgacacaaactcctatccccacgatttcgggaaatgctcttagggattatgcggaggcaaggggaataaaaatcggaacatgtgtcaactatccgttttacaacaattcagatccaacctacaacagcattttgcaaagagaattttcaatggttgtatgtgaaaatgaaatgaagtttgatgctttgcagccgagacaaaacgtttttgatttttcgaaaggagaccagttgcttgcttttgcagaaagaaacggtatgcagatgaggggacatacgttgatttggcacaatcaaaacccgtcatggcttacaaacggtaactggaaccgggattcgctgcttgcggtaatgaaaaatcacattaccactgttatgacccattacaaaggtaaaattgttgagtgggatgtggcaaacgaatgtatggatgattccggcaacggcttaagaagcagcatatggagaaatgtaatcggtcaggactaccttgactatgctttcaggtatgcaagagaagcagatcccgatgcacttcttttctacaatgattataatattgaagacttgggtccaaagtccaatgcggtatttaacatgattaaaagtatgaaggaaagaggtgtgccgattgacggagtaggattccaatgccactttatcaatggaatgagccccgagtaccttgccagcattgatcaaaatattaagagatatgcggaaataggcgttatagtatcctttaccgaaatagatatacgcatacctcagtcggaaaacccggcaactgcattccaggtacaggcaaacaactataaggaacttatgaaaatttgtctggcaaaccccaattgcaatacctttgtaatgtggggattcacagataaatacacatggattccgggaactttcccaggatatggcaatccattgatttatgacagcaattacaatccgaaaccggcatacaatgcaataaaggaagctcttatgggctattga

SEQ ID NO: 108 - protein, 574 aa, Bacteria
VWKPGLWNFLQMADEAGLTRDGNTPVPTPSPKPANTRIEAEDYDGINSSSIEIIGVPPEGGRGIGYITSGDYLVYKSIDFGNGATSFKAKVANANTSNIELRLNGPNGTLIGTLSVKSTGDWNTYEEQTCSISKVTGINDLYLVFKGPVNIDWFTFGVESSSTGLGDLNGDGNINSSDLQALKRHLLGISPLTGEALLRADVNRSGKVDSTDYSVLKRYILRIITEFPGQGDVQTPNPSVTPTQTPIPTISGNALRDYAEARGIKIGTCVNYPFYNNSDPTYNSILQREFSMVVCENEMKFDALQPRQNVFDFSKGDQLLAFAERNGMQMRGHTLIWHNQNPSWLTNGNWNRDSLLAVMKNHITTVMTHYKGKIVEWDVANECMDDSGNGLRSSIWRNVIGQDYLDYAFRYAREADPDALLFYNDYNIEDLGPKSNAVFNMIKSMKERGVPIDGVGFQCHFINGMSPEYLASIDQNIKRYAEIGVIVSFTEIDIRIPQSENPATAFQVQANNYKELMKICLANPNCNTFVMWGFTDKYTWIPGTFPGYGNPLIYDSNYNPKPAYNAIKEALMGY

SEQ ID NO: 109 - DNA, 1242 bp, Unknown
  Obtained from an environmental sample
atgctaaaagttttacgtaaacctattatttctggattagctttagctctattattgccggcaggggcagctggtgccgaaactaatatttcaaagaagccaaatataagtggattaaccgcgccgcaattagaccaaagatataaagattctttcaccattggtgctgcggttgagccgtatcaattattagatgcaaaagattcacaaatgctaaagcggcattttaatagtatcgtagcagagaatgtcatgaagcctagtagtttacagccagtagaaggacaattcaattgggagccggccgataaacttgttcagtttgcgaaggaaaatggaatggacatgcgcggacatacgcttgtctggcatagccaggtaccggattggttctttgaagatgcggcaggaaatccaatggttgtttgggaaaatggcaggcaagtggttgccgatccagcaaatcttcaggaaaacaaagagctcttacttagccgattacaaaatcatattcaggcagtcgtaacgcgttataaagatgatataaaatcttgggatgttgttaatgaagtaatcgatgaatggggcggacattctgaagggctgcgtcaatctccatggttcctcatcaccggaacggactatattaaagttgcttttgaaactgcaagagaatatgcagctccagacgctaagctgtatatcaatgattacaatacagaagtagaaccaaaaaggacgcacctttataacttagtaaaaagtttaaaagaagaacaaaacgttccaattgatggtgttgggcatcagtctcacattcaaattggctggccttcagaaaaagaaattgaagataccattaatatgtttgcagatcttggtttagataaccaaatcaccgagcttgatgttagtatgtatggctggccagtaaggtcgtatccaacttatgatgcgatcccagaacttaaattcatggatcaagcagctcgttatgatcgtttatttaagttatatgagaaattaggagataaaatcagtaatgtgacattctggggtattgcggataaccatacatggctgaatgaccgtgcagatgtttactatgatgaaaatggaaatgttgtattagatagagaaacaccaagagtagaaagaggagcaggaaaagatgcgccatttgtatttgatcctgaatacaatgtaaaaccagcttattgggcaattatcgaccacaaataa

SEQ ID NO: 110 - protein, 413 aa, Unknown
  Obtained from an environmental sample
  SIGNAL (1)...(26)
MLKVLRKPIISGLALALLLPAGAAGAETNISKKPNISGLTAPQLDQRYKDSFTIGAAVEPYQLLDAKDSQMLKRHFNSIVAENVMKPSSLQPVEGQFNWEPADKLVQFAKENGMDMRGHTLVWHSQVPDWFFEDAAGNPMVVWENGRQVVADPANLQENKELLLSRLQNHIQAVVTRYKDDIKSWDVVNEVIDEWGGHSEGLRQSPWFLITGTDYIKVAFETAREYAAPDAKLYINDYNTEVEPKRTHLYNLVKSLKEEQNVPIDGVGHQSHIQIGWPSEKEIEDTINMFADLGLDNQITELDVSMYGWPVRSYPTYDAIPELKFMDQAARYDRLFKLYEKLGDKISNVTFWGIADNHTWLNDRADVYYDENGNVVLDRETPRVERGAGKDAPFVFDPEYNVKPAYWAIIDHK

SEQ ID NO: 111 - DNA, 1089 bp, Unknown
  Obtained from an environmental sample
atgttgacgaccccgacaactcaagatcatgtccccgtgcttaaggacgctttcaaaggcaagttcctcattggagccgtgctgggttatgacgcactccagggaaaggatccggcgagtgtggaaattgcgaccacgcacttcgatgctctcactgcggaaaacagcatgaagcccgctctggtgcaacctaaagagggcgaatttgacttcgctgatggagaccggcttcttgacatcacacagcagtgcggtgcgactgcgattggccacactttgctctggcaccaacagacaccgaaatggtttttcgaggggccagatgaccagcctactaaccgcgagttggccctggcacgcatgagaaagcacatcgccactcttgttggccgttacaaaggtcgcattaagcaatgggatgtggtgaatgaggcgattagcgatgcagagggcgagtacttgagaccaaatagtccatggttcaaggctgttggagaagatcacattgcgcaggctttccgggcagcgcacgaagccgatcctgacgccatcctcatctataacgattacaacatcgagcaggagtacaagcgtcccaaagcgatacgactgctgaggtcattacttgagcaggacgttccccttcatgccgtgggcatccagggccactggcgtatggacactctgaatgttgccgaaatcgaagaagctatcaaagaatttgctgcgctgggtctcaaggtcatgatcaccgagcttgacatcagcgtgctaccgacaaagtatcagggagccgatctctctacccgcgaagaattgacgcctgaaatcaatccctatacggagggactacccgagaacgttgcccggcaacatgccgaatgttaccgccaagtcttcaaaatgttcctgtgccacaaggatgccattggccgtgtcacgctctggggcgttcatgatggcagatcatggttcaatgactttcccgtcagagggcgcaccgattatcctctgcttttcgaccggcagggcaaacccaagccagcattttttgccgtcttgaaggctgcgcaagatcagccacaatga

SEQ ID NO: 112 - protein, 362 aa, Unknown
  Obtained from an environmental sample
MLTTPTTQDHVPVLKDAFKGKFLIGAVLGYDALQGKDPASVEIATTHFDALTAENSMKPALVQPKEGEFDFADGDRLLDITQQCGATAIGHTLLWHQQTPKWFFEGPDDQPTNRELALARMRKHIATLVGRYKGRIKQWDVVNEAISDAEGEYLRPNSPWFKAVGEDHIAQAFRAAHEADPDAILIYNDYNIEQEYKRPKAIRLLRSLLEQDVPLHAVGIQGHWRMDTLNVAEIEEAIKEFAALGLKVMITELDISVLPTKYQGADLSTREELTPEINPYTEGLPENVARQHAECYRQVFKMFLCHKDAIGRVTLWGVHDGRSWFNDFPVRGRTDYPLLFDRQGKPKPAFFAVLKAAQDQPQ

SEQ ID NO: 113 - DNA, 1155 bp, Unknown
  Obtained from an environmental sample
atgttaaaagtattgcgtaaaccacttttttctggattagctttagcgatagtattacctaccggattatccagtgcttatgcagctgaaaatcaaccagttagtgcattagatgcagcggttgaacttgatgaaagatatgcagaatcattcgatattggtgcagccgttgagccttctatgcttcaaggaaaagatgctgaagtattaaagcgtcattataacagcattgtggccgaaaatgtaatgaaaccgattaatatacagcctgaagaaggaaagttcacttttaaagaaatggataaaatcgttaagtttgcgaaagaaaataatatgaagcttcgtggccatacccttatttggcacagtcaagtaccggagtggttcttccttgataaagaaggaaataagatggtggatgaaacggatccaaagcagcgcgaaaaaaataaaaggcttttacttaagcgtttagaaacgcatattaaaacgatcgtcaagcgctataaaaatgatattagctcctgggacgtggtcaacgaggtagtggatgataacgggaaattacgtaattcaccctggtatcaaatcacaggtactgattatatcaaggttgcttttgaaacagcggaccgttatgcagggaagaacgctaagctttatatcaatgactacaacacggaaatagaccctaaaagagaaaccctctataatcttgtcaaggaattagtgaaggagggagtcccagttgatggagtgggacatcaagctcatatccaaatcggctggccaactatagcggaaatcgagaaaaccattaatatgtttgcagaccttggcctagacaatcaaattacagaactagatgttagcctttatgggtggccgccaaagcctgcttacccaacttatgacgaaatcccggcaagtgaattcgaacgtcaagctgttcgttacgatcaactatttgatttatacgagagattgggagataaaattagcagtgtgacattctggggcgttgctgacaaccatacatggttaaatgaccgtgcagaacaatataatgacggggtaggcgtggacgcaccatttgttttcgataaggattataatgtaaaaccagcttattgggctattatcgatcgcgattaa

SEQ ID NO: 114 - protein, 384 aa, Unknown
  Obtained from an environmental sample
  SIGNAL (1)...(28)
MLKVLRKPLFSGLALAIVLPTGLSSAYAAENQPVSALDAAVELDERYAESFDIGAAVEPSMLQGKDAEVLKRHYNSIVAENVMKPINIQPEEGKFTFKEMDKIVKFAKENNMKLRGHTLIWHSQVPEWFFLDKEGNKMVDETDPKQREKNKRLLLKRLETHIKTIVKRYKNDISSWDVVNEVVDDNGKLRNSPWYQITGTDYIKVAFETADRYAGKNAKLYINDYNTEIDPKRETLYNLVKELVKEGVPVDGVGHQAHIQIGWPTIAEIEKTINMFADLGLDNQITELDVSLYGWPPKPAYPTYDEIPASEFERQAVRYDQLFDLYERLGDKISSVTFWGVADNHTWLNDRAEQYNDGVGVDAPFVFDKDYNVKPAYWAIIDRD

SEQ ID NO: 115 - DNA, 1362 bp, Unknown
  Obtained from an environmental sample
atgacgaaccgtaaatcgaacgtgcaccgttcattgaccgatgatttgctcgatggtgtcttcgccgaggcaaaagcgggcaaagttgagaagtaccgtgccaccgggatccttggaacgctattcggattcactgtggcgtcctccatcatgttggcggcttgcagcaacgcacaagagaatgttccaccagttgcttcatccaccgcacagagcaatatcacccaggagaacgttccgccgctcaaagatgcgtttaagggcaagttcttgattggcaccgcggtgagcaatcgcttgctggagggacaagatccggccacggaagccttggtgcgcaggcacttcgatgctctcacggcggaaaacgccatgaagccggatgcactgcaaccgcgcgaaggccagttcaacttcgtcgccgccgaccgtctggtggaaatcgcccagcaaagcggcgcgacagtggtcggccacacgctggtctggcactcccaaacgccaggctggttcttccagggtccgaatggccagccagcgagtcgagaactggccctggcgcggatgcgaacacacatcaagacggtggtgggacgctacaaagggcgcatcaagcagtgggatgtggtcaacgaagcgatcaacgacggccctggcgtgctgcggcaaagtccgtggctgcgtgccatcggcgaagactacatcgccgaagcgttccgcgccgcgcacgaagccgatcctgacgccattctggtctacaacgactacaacatcgaactcaactacaagcgtcccaaggcgctggaactgctaaagaagctcatcgaccagaaggttccgattcatggtgtgggcattcaggctcactggcgcatgaccccgccgctggccgagaccgaagaagccatcaaacagttcgccgcgctgggcctgaaggtgatgttcaccgaactggacatcggtgtgctgcccactcagtatcagggggctgacatctcggcgcgtgaaaccatgacacccgaacagcaagcggtgatgaacccttacactcagggcttgccggctgaagtggcacagcaacatgccgagcgctaccgacaggccttcgagctgttcctgcgccacaaggatgtgattggtcgcgtcacgctctggggcacgcatgatggcgaatcctggctgaacggttttccggtgcggggccgcaccgactatcccttgctcttcgaccgccggtatcagccaaaaccagccttcttcgccgtcaggcaggttgcacaggcgcatactgtacaaacgaccggtgcgcaaacccaagctacagcgaagacaattcaaaaagcttctcgagagtacttctag

SEQ ID NO: 116 - protein, 453 aa, Unknown
  Obtained from an environmental sample
MTNRKSNVHRSLTDDLLDGVFAEAKAGKVEKYRATGILGTLFGFTVASSIMLAACSNAQENVPPVASSTAQSNITQENVPPLKDAFKGKFLIGTAVSNRLLEGQDPATEALVRRHFDALTAENAMKPDALQPREGQFNFVAADRLVEIAQQSGATVVGHTLVWHSQTPGWFFQGPNGQPASRELALARMRTHIKTVVGRYKGRIKQWDVVNEAINDGPGVLRQSPWLRAIGEDYIAEAFRAAHEADPDAILVYNDYNIELNYKRPKALELLKKLIDQKVPIHGVGIQAHWRMTPPLAETEEAIKQFAALGLKVMFTELDIGVLPTQYQGADISARETMTPEQQAVMNPYTQGLPAEVAQQHAERYRQAFELFLRHKDVIGRVTLWGTHDGESWLNGFPVRGRTDYPLLFDRRYQPKPAFFAVRQVAQAHTVQTTGAQTQATAKTIQKASREYF

SEQ ID NO: 117 - DNA, 1437 bp, Unknown
  Obtained from an environmental sample
atgacgaaccgtaaattgaacgtgcaccgttcattgagcgatgatttgctcgatggcgccttcgccgagtcaaaagcgggcaaagttgagaaataccgtgccacggggatccttggaacgctattcggattcactgtggcgtcctccatcatgttggcggcttgcagcaacgcacaagagaatgctccaccagttgcttcatccaccgcacaaagcaatatcacccaggagaacgttccgccgctcaaggatgcgtttaagggcaagttcttgattggcaccatcgcgagcaatcgcttgctgcagggacaagatccagccacagaagccctggtgcgcaggcacttcgacgccctcacggcggaaaatgccatgaagcctgatgccatgcaacccagagagggtgagttcaactttgccgccgctgaccgcctggtggaaatcgcccagcaaagcggcgccacggtggtcggccacaccttggtctggcatagccaaacgccaagctggttcttccagggtccagatggccaaccggcgagtcgggaactggccttggcacggatgcgaacgcacatcaagactgtggtgggacgctacaaaggacgcatcaagcaatgggatgtggtcaacgaagcgatcaacgacggccctggagtgctgcggccatcgccgtggttgcgcgccatcggcgaagacttcatcgccgaagcgttccgcgccgcgcacgaagctgatcccgacgcgattctcgtctacaacgactacaacatcgagctcaactacaagcgtcccaaggcgctggaactactgaagagactcatcgagcagaaggttccgattcatggtgtgggcattcaggctcactggcgcatgaccccgccgctggccgagatggaagagaccatcaagcagttttcggctttgggcttgaaggtaatgatcaccgagttggacattggtgtattgccaacacaataccagggtgccgacatctcggctcgcgagaccatgacacccgaacagcaagcggtgatgaacccttacacgcagggcttgccggctgaagtggcgcagcaacatgccgagcgttatcgtcaggcgtttgagctgttcatgcgttacaaggatgtgattggtcgcgttaccctgtggggcacgcatgatggcgaatcttggctgaacggttttcccgttcgtggccgcacggattatcctctactgttcgaccgccggtatcagcctaagcccgccttcttcgcggtgcaaaaggtcgcgcaggcgcagaacgcacaggcagcaaccgatcaagcaccacttgcacaaaacccagttgcgcagaagaaatctgcaccaaggcaggcggctcaaaatcagaccactcaaaagccagtggtacaaaagcaaagtgcggcaagtcgggccgcagaaaagtaa

SEQ ID NO: 118 - protein, 478 aa, Unknown
  Obtained from an environmental sample
MTNRKLNVHRSLSDDLLDGAFAESKAGKVEKYRATGILGTLFGFTVASSIMLAACSNAQENAPPVASSTAQSNITQENVPPLKDAFKGKFLIGTIASNRLLQGQDPATEALVRRHFDALTAENAMKPDAMQPREGEFNFAAADRLVEIAQQSGATVVGHTLVWHSQTPSWFFQGPDGQPASRELALARMRTHIKTVVGRYKGRIKQWDVVNEAINDGPGVLRPSPWLRAIGEDFIAEAFRAAHEADPDAILVYNDYNIELNYKRPKALELLKRLIEQKVPIHGVGIQAHWRMTPPLAEMEETIKQFSALGLKVMITELDIGVLPTQYQGADISARETMTPEQQAVMNPYTQGLPAEVAQQHAERYRQAFELFMRYKDVIGRVTLWGTHDGESWLNGFPVRGRTDYPLLFDRRYQPKPAFFAVQKVAQAQNAQAATDQAPLAQNPVAQKKSAPRQAAQNQTTQKPVVQKQSAASRAAEK

SEQ ID NO: 119 - DNA, 2559 bp, Unknown
  Obtained from an environmental sample
atgaaaaaaagattgttagcgttgatagtgacattagtttttattatctcattgtttaatcccatattcaccacacctttaacaaatgtagcaaaggctcaaagtaaccaaacaaatttaaaatttgactttgaaaacggtactcaaggttggggagcaagaggtgtttcaacaactattgcaaccgtttacgagcaagcttatgaaggaagttattctttaaaggtttcaggtagaagttcaacgtgggatggagcagttgtggatatcacatcaagtatttcagcaaatgtcacctatacagtttctttatttgttcgtcacagcgatgtaaaaccacaaagattttctgtctatgtatatgtcaaagataacacaggcgaaaaatacatccaggttgcagacaaagtggttatgccaaacttttggaagcagctctttgggaagttcacaatcacaacatcaaatccaattcaaaaagtagaacttcttgtatgtgttccatctaacaaatctttaggattttatcttgacaatgtagttattacttcagcacaaccagcttcctcgggtgttgttaaatcttgcacatttgaaagcggtagcactgagggttttgttcagagaggttcagcttcattgacagttgtcgacggtgtatactatcattctccaacaaaagcattatatgtgacaggaaggacagctacatggcagggtgcacagatagatatgacaagtttgcttgagaagggcaaggattatcagtttagcatatgggtatatcaaaatagtggaagtgatcagaagataacccttacgatgcaaaggaagaatgaagatggaactacgagttatgattctataaagtatcagcaaacagttccatctggtacatggacagaagtaacaggttcatacacagtgcctcagacagcaacacagcttatattctatgttgaatcaccgaatattaattttgacttctaccttgatgactttacagcggttgacaaaaacccacctgttgtaaacccagggcttgttaaatcttgcacatttgaaagcggtagcactgagggttttgttcagagaggttcagcttcattgacagttgtcgacggtgtatactatcattctccaacaaaagcattgtatgtgacaggaaggacagctacatggcagggtgcacagatagatatgacaagtttgcttgagaagggcaaggattatcagtttagcatatgggtatatcaaaatagtggaagtgatcagaagataacccttacgatgcaaaggaagaatgaagatggaactacgagttatgattctataaagtatcagcaaacagttccatctggtacatggacagaagtaacaggttcatacacagtgcctcagacagcaacacagcttatattctatgttgaatcaccgaatattaattttgacttctaccttgatgactttacagtaatagataaaaatccagtgacggtaccgattgcagcaaaagaacccgaatgggaaattccgtcactttgtcagcaatatagtcaatatttctcaataggtgttgcaataccgtataaagtacttcaaaatcctgttgaaagagcaatggtgttaaaacacttcaacagtataacagctgaaaatgagatgaaacctgacgctctgcaaagaacagaagggaactttacattcgatatagcagaccagtatgtaaacttcgcacagcaaaacggtattggaattagagggcatactctggtatggcacagccaagtacctaattggttcttccagcacagtgatggaacttcacttgatccaagcaatccagatgataagcaacttttgagagatagattgaaaaatcatattcaaactgttatgtcaagatacaaagggaaagtctatgcatgggatgttgtaaacgaggcaatagatgaaagccagcctgatggatttagaagaagcgaatggtacagaatacttggtccaacacctgagacaaatggtattccagaatacattgtgcttgctttcaggtatgcaagagaggcggatccggatgcaaaacttttctacaatgactacaacacagagatatctaaaaaaagacagtttatatatgacatggtaaaaaagctacatgatatgggtttaattgatggtgttggtttgcaagggcatataaatgttgattctccaacagtaaaagatatagaagatacaatcaatcttttctcaacaattcctggacttgagatacaggtaacagagcttgacataagcgtttacacaagcagcagtcagcgttatgatacgcttcctcaggatataatgataaaacaagcaatgaagtttaaagaactatttgaaatgttaaagagacatagtgatagagtcacaaatgtgacactttggggacttaaggatgattattcatggctttcaaaggatagaaataactggccattgctttttgacagcaactaccaggcaaaatacagctactgggcaattcaaaaagcttctcgagagtacttctag

SEQ ID NO: 120 - protein, 852 aa, Unknown
  Obtained from an environmental sample
  SIGNAL (1)...(33)
MKKRLLALIVTLVFIISLFNPIFTTPLTNVAKAQSNQTNLKFDFENGTQGWGARGVSTTIATVYEQAYEGSYSLKVSGRSSTWDGAVVDITSSISANVTYTVSLFVRHSDVKPQRFSVYVYVKDNTGEKYIQVADKVVMPNFWKQLFGKFTITTSNPIQKVELLVCVPSNKSLGFYLDNVVITSAQPASSGVVKSCTFESGSTEGFVQRGSASLTVVDGVYYHSPTKALYVTGRTATWQGAQIDMTSLLEKGKDYQFSIWVYQNSGSDQKITLTMQRKNEDGTTSYDSIKYQQTVPSGTWTEVTGSYTVPQTATQLIFYVESPNINFDFYLDDFTAVDKNPPVVNPGLVKSCTFESGSTEGFVQRGSASLTVVDGVYYHSPTKALYVTGRTATWQGAQIDMTSLLEKGKDYQFSIWVYQNSGSDQKITLTMQRKNEDGTTSYDSIKYQQTVPSGTWTEVTGSYTVPQTATQLIFYVESPNINFDFYLDDFTVIDKNPVTVPIAAKEPEWEIPSLCQQYSQYFSIGVAIPYKVLQNPVERAMVLKHFNSITAENEMKPDALQRTEGNFTFDIADQYVNFAQQNGIGIRGHTLVWHSQVPNWFFQHSDGTSLDPSNPDDKQLLRDRLKNHIQTVMSRYKGKVYAWDVVNEAIDESQPDGFRRSEWYRILGPTPETNGIPEYIVLAFRYAREADPDAKLFYNDYNTEISKKRQFIYDMVKKLHDMGLIDGVGLQGHINVDSPTVKDIEDTINLFSTIPGLEIQVTELDISVYTSSSQRYDTLPQDIMIKQAMKFKELFEMLKRHSDRVTNVTLWGLKDDYSWLSKDRNNWPLLFDSNYQAKYSYWAIQKASREYF

SEQ ID NO: 121 - DNA, 1905 bp, Unknown
  Obtained from an environmental sample
atgaagcatatttttattgtattaattgtttccctgctgtttagcttcgggggatatgctcaacaaaccattagcagagctccgcaggggtttgaccagcaacgtgccggcattgcatccggtaaagttgaaatcgtaacctataaatcgaaaaccgtaggagtgaatcgctctgcacgtgtttatacaccagccggattctcaaaaaagaagaaatatcctgtgctttatttattacatggcattggaggcgacgaagatgagtggtacaaaaacggcgttcctcatattattttcgacaacctgattgccgacggcaaaatggaaccgatgattgtggtactgcccaatggtcgcgccatgaaaaacgaccgtgccgaaggaaatattttcgacaaagagaaagttgaagcctttgcaacattcgaaaaagaccttttaaacgatttaataccgtttatcgaaaaaaaataccctgtattaaaaacccgtgagtttcgcgccattgcaggattatcaatgggcggcggacaatcgctcaattttggactgggaaatctcgacaaatttgcatgggtaggcggcttttcatcggcccccaataccaaaatgcccgctgagttggttccaaacactcaaaaggcaacagaaatgcttaagttgctttatgtgtcttgtggcgataaagacaatttaatgcaggttagtcagcgcacccacgattatctgaaagccaataaagtacctcatattttcagggttattcctgatggttaccacgattttaatgtttggaaagacgatttgtatcattacgtacaaatgctgtttaagcctgtggtaatgcccgtagcagcagctactttaaaagatgcttataaagggaaattcttcattggaactgcccttaatacccctcaaattttgggtaccgctgttgatgaagtgaatattgttaaaacccatttcaactccattgttgccgaaaactgtatgaagagtggcccgatgcaaccacaagaagggaaatttgagtttgacctggccgataagtttgtagagtttggagttaaaaacaatatgcagattattggtcatacgcttatctggcattcgcaggcaccccgctggttttttaccgacagcgaaggcaaggacgtatcgcccgaggtgcttaccgagcgcatgaaaaaccatatctatactgttgttggccgttacaaaggcaaggtgcacggatgggatgtggtgaatgaagccatagttgacgatggcagctaccgaaacagtaaattctaccaaatactgggcgaagattttatcaaactggcattccagtttgctcatgaagccgaccccgatgcagaattgtactacaacgattattccgaatttgttcctgccaaaagagaaggcattgcccgcatggtgaagaaactcaaagaccagggcattagaatcgacggcgttggatttcagtgccatattggcctcgattatccaggcctggatgaatacgaaaaaaccattcaattaattgccaacgagggggtaaaagtaatgataaccgaaatggaaatatcggtattacccatgcccgactggcgcgttggtgctgagatttcggccagtttcgaatatcaacagaaattaaatccctacaccgaaggattgcccgattcagtgaatgctcaattagaacagcgttatgtcgactttttcacgctcttccttaaatatcacgaagtgattccaagagttacggtttggggggttaacgatggcaactcatggaaaaacggattcccggtgcgtggaagaaccgactacccattgttattcgaccggaaaaatcagcctaaatcagctgttgccaaattaattgaactggctaatacaaagtag

SEQ ID NO: 122 - protein, 634 aa, Unknown
  Obtained from an environmental sample
  SIGNAL (1)...(20)
MKHIFIVLIVSLLFSFGGYAQQTISRAPQGFDQQRAGIASGKVEIVTYKSKTVGVNRSARVYTPAGFSKKKKYPVLYLLHGIGGDEDEWYKNGVPHIIFDNLIADGKMEPMIVVLPNGRAMKNDRAEGNIFDKEKVEAFATFEKDLLNDLIPFIEKKYPVLKTREFRAIAGLSMGGGQSLNFGLGNLDKFAWVGGFSSAPNTKMPAELVPNTQKATEMLKLLYVSCGDKDNLMQVSQRTHDYLKANKVPHIFRVIPDGYHDFNVWKDDLYHYVQMLFKPVVMPVAAATLKDAYKGKFFIGTALNTPQILGTAVDEVNIVKTHFNSIVAENCMKSGPMQPQEGKFEFDLADKFVEFGVKNNMQIIGHTLIWHSQAPRWFFTDSEGKDVSPEVLTERMKNHIYTVVGRYKGKVHGWDVVNEAIVDDGSYRNSKFYQILGEDFIKLAFQFAHEADPDAELYYNDYSEFVPAKREGIARMVKKLKDQGIRIDGVGFQCHIGLDYPGLDEYEKTIQLIANEGVKVMITEMEISVLPMPDWRVGAEISASFEYQQKLNPYTEGLPDSVNAQLEQRYVDFFTLFLKYHEVIPRVTVWGVNDGNSWKNGFPVRGRTDYPLLFDRKNQPKSAVAKLIELANTK

SEQ ID NO: 123 - DNA, 1200 bp, Unknown
  Obtained from an environmental sample
atgatcgttggattctcgtttatgctgctgcttcctttagggatgacgaatgcattggcaaaaacggaaccagcgtacgctaaaaagccgcgaatcagcgcattgcacgcccctcaattggatcagcgctacaaagattccttcactattggggcggccgttgaaccttatcagttgcaaaacgaaaaagacgtccaaatgctgaaacgccattttaacagcattgtcgctgagaacgttatgaaaccgatcaacatccaacccgaagaaggaaagttcaattttgctgaggcggatcaaatcgtccgatttgctaaaaaacatcatatggatattcgtttccatacactcgtttggcacagccaagtacctcaatggttctttcttgacaaggaaggcaagccgatggtcaatgaaacggatccggcaaagcgcgaacaaaataaacagctgttactgaaacggctcgaaatccatattaaaacgattgtcgaacggtataaagacgacatcaaatattgggacgtcgtgaacgaggtagtcggggatgatggaaaattgcgcaattccccgtggtatcaaatcgccggcatcgattatatcaaggtagcattccaaacggcgagaacatatggcggcaacaagattaaactgtacatcaacgattacaataccgaagtggaaccgaagcgaagcgctctttataacttagtgaaacaattaaaagaagaaggcgttcccattgacgggattggccaccagtcccacatccaaattggctggccttctgaagaagaaatcgaaaaaacgatcaacatgtttgccgatctagggttagacaatcaaattacggagctggatgtgagcatgtacggctggccgccgcgcgcctacccgtcgtatgacgccattccggaacaaaagtttttggaccaagcggctcgctatgaccgattgtttaagctgtacgaaaaacttggcgataaaatcagcaacgtcaccttctggggcatcgccgacaaccatacgtggctcgacagccgtgcggatgtgtactatgacgccaacgggaatgttgtggttgacccgaacgctccgtacgcaaaagtggaaaaagggaaaggaaaagatgcgccgtttctgttcgaccccgaataccacgtaaaacctgcgtattgggccattatcgatcataagtga

SEQ ID NO: 124 - protein, 399 aa, Unknown
  Obtained from an environmental sample
  SIGNAL (1)...(20)
MIVGFSFMLLLPLGMTNALAKTEPAYAKKPRISALHAPQLDQRYKDSFTIGAAVEPYQLQNEKDVQMLKRHFNSIVAENVMKPINIQPEEGKFNFAEADQIVRFAKKHHMDIRFHTLVWHSQVPQWFFLDKEGKPMVNETDPAKREQNKQLLLKRLEIHIKTIVERYKDDIKYWDVVNEVVGDDGKLRNSPWYQIAGIDYIKVAFQTARTYGGNKIKLYINDYNTEVEPKRSALYNLVKQLKEEGVPIDGIGHQSHIQIGWPSEEEIEKTINMFADLGLDNQITELDVSMYGWPPRAYPSYDAIPEQKFLDQAARYDRLFKLYEKLGDKISNVTFWGIADNHTWLDSRADVYYDANGNVVVDPNAPYAKVEKGKGKDAPFLFDPEYHVKPAYWAIIDHK

SEQ ID NO: 125 - DNA, 1089 bp, Unknown
  Obtained from an environmental sample
atgttgacgaccccgacaactcaagatcatgtccccgtgctcaaggacgctttcaaaggcaagctcctcattggagccgtgctcggttacgatgctctccaggggaaggacccgctgagtgagaaaattgcgaccactcacttcgatgctctcactgctgaaaacagcatgaagccggctctcgtgcaacccaaagagggcgagtttgatttcgctgatggagatcgtctccttgaaatcgcgcagcaatgcggcgctactgcaatcggccatactctgctctggcaccaacaaacgccacgctggttttttgaagggccagatggtcagcctgctgaccgtgagttggccctggcacgcatgaggaagcacatttccactctcgttggtcgctataaaggtcgcattaaacaatgggatgtggtgaatgaggcgattagcgatgcagagggcgagtacttaagaccaaagagcccctggttcaaagccgttggagaggatcacatcgcgcatgctttccaggcagcacatgaagctgatcccgatgccatccttatctataacgactacaacatcgagcaggagtacaagcgcccgaaggcgatacgcctactgaggtcattacttgagcaggacgttcccattcatgccgtgggcattcagggccattggcgtatggacactctgaatgttgccgaaatcgaagaagctatcgaagaatttgctgcgctgggtctcaaggtcatgatcaccgagcttgatatcagcgtgctaccgacaaagtatcagggagccgatctcgctactcgggaagaattgacgcctgaaatcaatccctatacggaggaactacctgaggacgttgcccggcaacatgccgagtgttatcggcaggtcttcgaaatgttcctgcgccacaaggatgccattagccgtgtcacgctctggggcattcacgatggcagatcatggttcaacaactttccggtcagggggcgcacagactatcctctgctattcgaccgggaatgtaaccccaagccagcgtttttcgccgtcttgaaagctgcgcaagaccagccacaatga

SEQ ID NO: 126 - protein, 362 aa, Unknown
  Obtained from an environmental sample
MLTTPTTQDHVPVLKDAFKGKLLIGAVLGYDALQGKDPLSEKIATTHFDALTAENSMKPALVQPKEGEFDFADGDRLLEIAQQCGATAIGHTLLWHQQTPRWFFEGPDGQPADRELALARMRKHISTLVGRYKGRIKQWDVVNEAISDAEGEYLRPKSPWFKAVGEDHIAHAFQAAHEADPDAILIYNDYNIEQEYKRPKAIRLLRSLLEQDVPIHAVGIQGHWRMDTLNVAEIEEAIEEFAALGLKVMITELDISVLPTKYQGADLATREELTPEINPYTEELPEDVARQHAECYRQVFEMFLRHKDAISRVTLWGIHDGRSWFNNFPVRGRTDYPLLFDRECNPKPAFFAVLKAAQDQPQ

SEQ ID NO: 127 - DNA, 960 bp, Unknown
  Obtained from an environmental sample
gtggatctcgctgagaaatgcggcatatatattggtgcagcggttgaacccggatatttaattatcagggaatacgctgagattttatcccgcgaatttaacgtggtaaccgcggaaaatgcattaaaatttgaagctattcatccgcagcgtggagtatattcatttgaaggtgcagatgcaatagttcgatttgcagaaactcatggaatgaaggttcgtggacatacacttgtttggcaccagcagcttcctgcatggataacttctggaagttacgcttgggaggagtggaagaatattctccgtgagcatgtaatgagcgttgttggacgatataagggccaaatatatgcatgggatgtggttaacgaagcaatattagataacggttcattaagagataatgtttggtttagaaatgtaggtccagaatatattgagtcagcctttagatgggctcatgaagctgacccaaacgctcttctcttctataatgattatgaagctgaggacttgaatgataagtcgcatgctgtttataacctggttaagagtttacttgagaaaggtgtaccgatacatggcgtaggattacagatgcatattaacgtagaaaatccgccgaaaccggaagatgttgcagcaaacattaaacgtctaaatgatctgggcttgattgtccacataacggaaatggatgtgcgcattagaaccccaccatcaaatgaagatctcattaaacaagcagaaatttaccgtgatatattaagagtttgtctttcatcagaaaaatgcacagcattcattatgtggggatttactgaccgctattcatggataccaaattacttcagcggctacggttcagctttaatattcgatgagcaatataagcccaaactagcatattactatatacttcggacattcatcgaaaaactaggcattaaaggttaa

SEQ ID NO: 128 - protein, 319 aa, Unknown
  Obtained from an environmental sample
VDLAEKCGIYIGAAVEPGYLIIREYAEILSREFNVVTAENALKFEAIHPQRGVYSFEGADAIVRFAETHGMKVRGHTLVWHQQLPAWITSGSYAWEEWKNILREHVMSVVGRYKGQIYAWDVVNEAILDNGSLRDNVWFRNVGPEYIESAFRWAHEADPNALLFYNDYEAEDLNDKSHAVYNLVKSLLEKGVPIHGVGLQMHINVENPPKPEDVAANIKRLNDLGLIVHITEMDVRIRTPPSNEDLIKQAEIYRDILRVCLSSEKCTAFIMWGFTDRYSWIPNYFSGYGSALIFDEQYKPKLAYYYILRTFIEKLGIKG

SEQ ID NO: 129 - DNA, 3021 bp, Bacteria
atggtaataaatcgctccagtgcgagtgacggtgcgtattcggaaaaaggtttctatctcgacggtggtgtagaatacaagtacagtgtttttgtaaaacacaacgggaccggcaccgaaactttcaaactttctgtgtcctatttggattcggaaacagaagaagaaaataaggaagtaattgcaacaaaggatgttgtggccggagaatggactgagatttcggcaaaatacaaagcacccaaaactgcagtgaatattactttgtcaattacaaccgacagcactgtagatttcatttttgacgatgtaaccataacccgtaaaggaatggctgaggcaaacacagtatatgcagcaaacgctgtgctgaaagatatgtatgcaaactatttcagagttggttcggtacttaactccggaacggtaaacaattcatcaataaaggccttgattttaagagagtttaacagtattacctgtgaaaatgaaatgaagcctgatgccacactggttcaatcaggatcaaccaatacaaatatcagggtttctcttaatcgtgcagcaagtattttaaacttctgtgcacaaaataatatagccgtcagaggtcatacactggtttggcacagccagacacctcaatggtttttcaaagacaatttccaggacaacggaaactgggtttcccaatcagttatggaccagcgtttggaaagctacataaaaaatatgtttgctgaaatccaaagacagtatccgtctttgaatctttatgcctatgacgttgtaaatgaggcagtaagtgatgatgcaaacaggaccagatattatggcggggcgagggaacctggatacggaaatggtagatctccatgggttcagatctacggagacaacaaatttattgagaaagcatttacatatgcaagaaaatatgctccggcaaattgtaagctttactacaacgattacaacgaatattgggatcataagagagactgtattgcctcaatttgtgcaaacttgtacaacaagggcttgcttgacggtgtgggaatgcagtcccatattaatgcggatatgaatggattctcaggtatacaaaattataaagcagctttgcagaaatatataaatatcggttgtgatgtccaaattaccgagcttgatattagtacagaaaacggcaaatttagcttacagcagcaggctgataaatataaagctgttttccaggcagctgttgatataaacagaacctccagcaaaggaaaggttacggctgtctgtgtatggggacctaatgacgccaatacttggctcggttcacaaaatgcacctcttttgtttaacgcaaacaatcaaccgaaaccggcatacaatgcggttgcatccattattcctcagtccgaatggggcgacggtaacaatccggccggcggcggaggaggaggcaaaccggaagagccggatgcaaacggatattattatcatgacacttttgaaggaagcgtaggacagtggacagccagaggacctgcggaagttctgcttagcggaagaacggcttacaaaggttcagaatcactcttggtaaggaaccgtacggcagcatggaacggagcacaacgggcgctgaatcccagaacgtttgttcccggaaacacatattgtttcagcgtagtggcatcgtttattgaaggtgcgtcttccacaacattctgcatgaagctgcaatacgtagacggaagcggcactcaacggtatgataccatagatatgaaaactgtgggtccaaatcagtgggttcacctgtacaatccgcaatacagaattccttccgatgcaacagatatgtatgtttatgtggaaacagcggatgacaccattaacttctacatagatgaggcaatcggagcggttgccggaactgtaatcgaaggacctgctccacagcctacacagcctccggtactgcttggcgatgtaaacggtgatggaaccattaactcaactgacttgacaatgttaaagagaagcgtgttgagggcaatcacccttaccgacgatgcaaaggctagagcagacgttgacaagaatggatcgataaacagcactgatgttttacttctttcacgctaccttttaagagtaatcgacaaatttcctgtagcagaaaatccttcttcttcttttaaatatgagtcggccgtgcaatatcggccggctcctgattcttatttaaacccttgtccgcaggcgggaagaattgtcaaggaaacatatacaggaataaacggaactaagagtcttaatgtatatcttccatacggttatgatccgaacaaaaaatataacattttctaccttatgcatggcggcggtgaaaatgagaatacgattttcagcaacgatgttaaattgcaaaatatccttgaccacgcgattatgaacggtgaacttgagcctttgattgtagtaacacccactttcaacggcggaaactgcacggcccaaaacttttatcaggaattcaggcaaaatgtcattccttttgtggaaagcaagtactctacttatgcagaatcaacaaccccacagggaatagccgcttcaagaatgcacagaggtttcggcggattctcaatgggaggattgacaacatggtatgtaatggttaactgccttgattacgttgcatattttatgcctttaagcggtgactactggtatggaaacagtccgcaggataaggctaattcaattgctgaagcaattaacagatccggactttcaaagagggagtatttcgtatttgcggccaccggttccgaggatattgcatatgctaatatgaatcctcaaattgaagctatgaaggctttgccgcattttgattatacttcggatttttccaaaggtaatttttactttcttgtagctccgggcgccactcactggtggggatacgtaagacattatatttatgatgcacttccatatttcttccatgaatga

SEQ ID NO: 130 - protein, 1006 aa, Bacteria
MVINRSSASDGAYSEKGFYLDGGVEYKYSVFVKHNGTGTETFKLSVSYLDSETEEENKEVIATKDVVAGEWTEISAKYKAPKTAVNITLSITTDSTVDFIFDDVTITRKGMAEANTVYAANAVLKDMYANYFRVGSVLNSGTVNNSSIKALILREFNSITCENEMKPDATLVQSGSTNTNIRVSLNRAASILNFCAQNNIAVRGHTLVWHSQTPQWFFKDNFQDNGNWVSQSVMDQRLESYIKNMFAEIQRQYPSLNLYAYDVVNEAVSDDANRTRYYGGAREPGYGNGRSPWVQIYGDNKFIEKAFTYARKYAPANCKLYYNDYNEYWDHKRDCIASICANLYNKGLLDGVGMQSHINADMNGFSGIQNYKAALQKYINIGCDVQITELDISTENGKFSLQQQADKYKAVFQAAVDINRTSSKGKVTAVCVWGPNDANTWLGSQNAPLLFNANNQPKPAYNAVASIIPQSEWGDGNNPAGGGGGGKPEEPDANGYYYHDTFEGSVGQWTARGPAEVLLSGRTAYKGSESLLVRNRTAAWNGAQRALNPRTFVPGNTYCFSVVASFIEGASSTTFCMKLQYVDGSGTQRYDTIDMKTVGPNQWVHLYNPQYRIPSDATDMYVYVETADDTINFYIDEAIGAVAGTVIEGPAPQPTQPPVLLGDVNGDGTINSTDLTMLKRSVLRAITLTDDAKARADVDKNGSINSTDVLLLSRYLLRVIDKFPVAENPSSSFKYESAVQYRPAPDSYLNPCPQAGRIVKETYTGINGTKSLNVYLPYGYDPNKKYNIFYLMHGGGENENTIFSNDVKLQNILDHAIMNGELEPLIVVTPTFNGGNCTAQNFYQEFRQNVIPFVESKYSTYAESTTPQGIAASRMHRGFGGFSMGGLTTWYVMVNCLDYVAYFMPLSGDYWYGNSPQDKANSIAEAINRSGLSKREYFVFAATGSEDIAYANMNPQIEAMKALPHFDYTSDFSKGNFYFLVAPGATHWWGYVRHYIYDALPYFFHE

SEQ ID NO: 131 - DNA, 1218 bp, Unknown
  Obtained from an environmental sample
atgccgatcatccgaaccctatcgagttacatgcgaaatcatcaagcgatctaccgtcagctcctcacgctggccgccgccgtcacgctggcgggcgcggccaccgcggaggaagaagccaccctgcgcggggtttacgaaaaggacttcaccatcggcgtggccatgaacgggggccaggcctccggccgcaatgccgccgccggcgagatcatcggcaagcagttctcctcgctcaccgcggagaacgacatgaagtggcagatgatccacccccaggagggtcaataccgcttcgaaacgtccgacgcctacgtcgcgttcgcggaaaagcacaagatggaagtcatcggccacaccctcgtgtggcacagccagaccccgcagtgggtcttccagggtgaaaacggccagcccgccaccaaggaagagctgctcaagcgcatgcgcgaccacatccacgccgtggccggccgttacaagggcaagatcaagggctgggacgtcgtcaacgaagcgctctccgacggcggggacgacattctccgccagtccccctggcgccgcatcatcggcgacgacttcatcgactacgccttccgctacgccaaggaagccgccccggatgccgagctctactacaacgactacaacctcgagatcccccgcaagcgcgccaattgcatcacgctggtcaagggcatgctcgagcgcggcgtgccgatcgacggcatcggcacccagtcgcacttccagctcggctttccctccttggacgacgtggaagccaccatcaaggaattcgccgccctgggcatgaaggtgatgatcaccgagctcgacgtggatgtcctgccccgcaacaaccccggggtcgccgacatcgccaaccgcgaacagggagccaacccctacaccgaaggccttccggacgacgtgcaggaaaagctcgcgaagcgctacgaggacatcttccgcatctacctgaagtaccgcgaccacgtcacccgcgtcaccttctggggcctggatgacggcatgacctggctgaacggcttcccggtccgcggccgcaccaaccaccccctgctctacgaccggcagctcaatgccaagcccgccttccacgccctcgtcaagctgggtcaggaagagcgtccggaagccgccaaggtcgaggtccagaagatcgaagcgaagaaagaagaggcgaagtaa

SEQ ID NO: 132 - protein, 405 aa, Unknown
  Obtained from an environmental sample
  SIGNAL (1)...(26)
MPIIRTLSSYMRNHQAIYRQLLTLAAAVTLAGAATAEEEATLRGVYEKDFTIGVAMNGGQASGRNAAAGEIIGKQFSSLTAENDMKWQMIHPQEGQYRFETSDAYVAFAEKHKMEVIGHTLVWHSQTPQWVFQGENGQPATKEELLKRMRDHIHAVAGRYKGKIKGWDVVNEALSDGGDDILRQSPWRRIIGDDFIDYAFRYAKEAAPDAELYYNDYNLEIPRKRANCITLVKGMLERGVPIDGIGTQSHFQLGFPSLDDVEATIKEFAALGMKVMITELDVDVLPRNNPGVADIANREQGANPYTEGLPDDVQEKLAKRYEDIFRIYLKYRDHVTRVTFWGLDDGMTWLNGFPVRGRTNHPLLYDRQLNAKPAFHALVKLGQEERPEAAKVEVQKIEAKKEEAK

SEQ ID NO: 133 - DNA, 1011 bp, Unknown
  Obtained from an environmental sample
atgaaaaataatcaatttaggaaaatcccttccctacataaggtatataagagtcattttttaattggggcagctgtaaatccacttacacttcaaacacaacaggaactaatcaaaaagcactttaatagtattacggcagaaaatgaaatgaaatttgaagagttgcaacctgagcctggacattttacatttgatgtaggagataaaatggtcgctttcgcaaaagaaaatggtatgaaagttagaggtcatacattaatctggcacaatcaaacacctgattggatgtttaagaatgaagatggttctgtcacagatcgagatacacttcttgaaagaatgaaattacatattacaactgttatggagcattataaggggcaaatttattgttgggatgttgtcaatgaagcgattgctgatgaaggatcagagttattacgtcactctaaatggactgaaattattggcgacgattttattgaaaaggcatttgagtatgcacatgaagcagacccagaagctttactattctataatgactataatgagtcccaccctcataagcgagataaaatttacacactaataaaaagattggtagacaaaggcatacctattcacggggttggcttgcaagcacattggaatttaacagacccttcttatgaggagattagggctgcaattgaaaaatatgcctcattaggcttggaaatacatcttacagaaatggatgtttcagtgttcaattttgaagatcgaagaacagacttaacagagccgactaatgaaatgaagactcttcaagtagaacgttatacggaatttttcaaaatacttagagaatatagccatgtgattagctctgtcactttttggggagctgcagatgattatacttggttggatgggtttccagttagaggaaggaaaaactggccatttgtttttgacgaaaaccaccaaccgaaagaatctttctggggaattgtcgattttgaataa

SEQ ID NO: 134 - protein, 336 aa, Unknown
  Obtained from an environmental sample
MKNNQFRKIPSLHKVYKSHFLIGAAVNPLTLQTQQELIKKHFNSITAENEMKFEELQPEPGHFTFDVGDKMVAFAKENGMKVRGHTLIWHNQTPDWMFKNEDGSVTDRDTLLERMKLHITTVMEHYKGQIYCWDVVNEAIADEGSELLRHSKWTEIIGDDFIEKAFEYAHEADPEALLFYNDYNESHPHKRDKIYTLIKRLVDKGIPIHGVGLQAHWNLTDPSYEEIRAAIEKYASLGLEIHLTEMDVSVFNFEDRRTDLTEPTNEMKTLQVERYTEFFKILREYSHVISSVTFWGAADDYTWLDGFPVRGRKNWPFVFDENHQPKESFWGIVDFE

SEQ ID NO: 135 - DNA, 1170 bp, Unknown
  Obtained from an environmental sample
atgcgacgcctcatcgcccttgtcctatatataggaaccgccgcgagcgggacctccgtggagaccgttgcggccgaatcgaaacagccgaaagctagcctaaagaatgcgttcgcagacgattttcgtgtcggcgctgcaattggcaccaatcaggtcatgggcgaggagccaaaatcgctcgaggttgtcgcccagcagttcaacacaatcacgcctgagaatctcctcaaatgggctgaggtccacccagaagcagaccgctacaacttcgaaccgtccgatcgcttcgtcgaatttggcgaaaagaacaacatgttcatcgtcggccacacgctcgtgtggcataaccaaacgccggactgggcctttgagggcaaggacggcaagccgctcgatcgcgaaacagcgctcgcccgaatcaaggaacacattgaaaccgtggtcggccgatatcgcggccgcatccatgcttgggacgtcgtgaacgaggcaatcgacgacaacggcaaacttcgtagtgggccggtcggagtgcccggtcagcgcggcgaaccgtggcacgccgccatcggagacgactacatccagaaggcgttcgaattcgcgcacaccgccgaccccgacgctgaactctattacaacgactacaacgaatggcacccgaaaaagatcgaagccatctcgcagctggtgcggtcgctcaaagagaagggcgttcgtatcgatggcctcggtctccagggccattgggggatggattacccgaaagtcgaagagatcgatcacatgctaaccgagtatggcaagctcggcgtgaagctcatgattaccgaactcgacatcaacatgcttccgcagcccgacccgagtcaacgcggcgccgatatcactcgcaactacgagctcagaaaggagctcgatccgtattccgacggactcccgcccgatatgcaaaaggcactcgcggcgcgttatgctgaaatcttcgaagtcttcgctaagcatcgcgataagctcgaccgcgtcacattttggggcgttcacgacggccattcatggctcaacaactggcctgttcccggtcgcactgcctacccgcttctcttcgacacgaagcttcagcccaagccggcatttgatgccgtcatcggagtcgcagagcaatga

SEQ ID NO: 136 - protein, 389 aa, Unknown
  Obtained from an environmental sample
  SIGNAL (1)...(25)
MRRLIALVLYIGTAASGTSVETVAAESKQPKASLKNAFADDFRVGAAIGTNQVMGEEPKSLEVVAQQFNTITPENLLKWAEVHPEADRYNFEPSDRFVEFGEKNNMFIVGHTLVWHNQTPDWAFEGKDGKPLDRETALARIKEHIETVVGRYRGRIHAWDVVNEAIDDNGKLRSGPVGVPGQRGEPWHAAIGDDYIQKAFEFAHTADPDAELYYNDYNEWHPKKIEAISQLVRSLKEKGVRIDGLGLQGHWGMDYPKVEEIDHMLTEYGKLGVKLMITELDINMLPQPDPSQRGADITRNYELRKELDPYSDGLPPDMQKALAARYAEIFEVFAKHRDKLDRVTFWGVHDGHSWLNNWPVPGRTAYPLLFDTKLQPKPAFDAVIGVAEQ

SEQ ID NO: 137 - DNA, 1044 bp, Unknown
  Obtained from an environmental sample
gtggatccttcgctgaaggaagcagcttcgggcaagtttctgatgggggtagcgttgaatgtacgtcaggcagcaggtcaggatacttgcgcctcgaaagtggtaaaacgtcattttaattccattgtggccgagaattgcatgaaatgcgaagtgattcatccggaggaagaccattttgattttacggaagcggaccggttggttcgttttggcgaggagaacgatatggctgttatcgggcattgccttatctggcattcacagctggcaccttggttctgtgtggacaaacaaggaaaaacagtaagtgccgacatcttgaaggagcgtataaaaaaacatatccagactattgtgacgcactataaagggcgtataaagggctgggatgtgttgaatgaagccattgaatcggacggctcctggcgtaaatctcctttttacgagatattaggcgaagagtacatcccgcttatttttcagtatgctcatgaggcagatccggaagccgaactttactataatgattatggcatggacgggaaggctaagcgtgacaaagtagtcgaattggtaaagatgctgaaagatcgtggactgcgcatcgacgcggtaggtatgcagggacacatgggaatggattatccgtcagtgtccgaatttgaagccagtatactggcatttgcagctgccggagtaaaggtgatggtaaccgaatgggatatgagtgcattgcccacgacacggatgggagccaatatttcggacacggtgtcttataaacaatccctgaatccctatcccgacggtttgcccgactctgtgtctgtggcatggaataaccggatgaaggaatttttcggtcttttcctgaaacattcgaatatcattacccgtgtgacggcgtggggggtgacggacggtgactcatggaagaataatttccctgtgcccggacgtgtggattatcctttattgttcgaccgtgattgccggccgaaaccttttgtggaagaactgattggaaaacagaacatttaa

SEQ ID NO: 138 - protein, 347 aa, Unknown
  Obtained from an environmental sample
VDPSLKEAASGKFLMGVALNVRQAAGQDTCASKVVKRHFNSIVAENCMKCEVIHPEEDHFDFTEADRLVRFGEENDMAVIGHCLIWHSQLAPWFCVDKQGKTVSADILKERIKKHIQTIVTHYKGRIKGWDVLNEAIESDGSWRKSPFYEILGEEYIPLIFQYAHEADPEAELYYNDYGMDGKAKRDKVVELVKMLKDRGLRIDAVGMQGHMGMDYPSVSEFEASILAFAAAGVKVMVTEWDMSALPTTRMGANISDTVSYKQSLNPYPDGLPDSVSVAWNNRMKEFFGLFLKHSNIITRVTAWGVTDGDSWKNNFPVPGRVDYPLLFDRDCRPKPFVEELIGKQNI

SEQ ID NO: 139 - DNA, 1143 bp, Unknown
  Obtained from an environmental sample
atgaaaaaaacgattgcacatttcaccttatggatagtgttttttctcttcacttcctgtactgttacggcgcagaagaatgctaagaatgcaagagtaaaacccactaccctaaaagaggcttaccaaggtaaattctatatcggtactgcgatgaacttgagacagattcacggagatgatccccaatctgaaaatattatcaaaaaacagttcaattccatagttgccgaaaactgcatgaagagtatgtatcttcagccggaggaaggaaaatttttcttcgatgatgcggacaagtttgtggattttggtcttcagaacaatatgttcattatcgggcattgtctgatttggcattcgcaggcgccaaaatggtttttcaccgacgaaaatggaaacacggtttctccagaagttcttaaacaaaggatgaaagcccatatcaccgctgtcgtttcccgctacaaagggaaaatcaaaggttgggatgtggtgaacgaagccattatggaagatggttcttaccgcaaaagcaaattttacgagattttgggagaagaatttattccgttggcatttcagtatgcgcatgaagcagatcctgatgcagaactttattacaacgattataacgaatggtatcccgggaaaagagctatggtgaccaaaataatccgcgatttcaaaactagaggaatccgcatcgatgccatcggaatgcaggctcatttcgggatggattcgcccactgtagaagagtatgaacaaactattcagggctatataaaagaaggcgtgaaagtcaatattacggaactcgatttaagtccgcttccttctccttggggaacttccgccaacgttgctgatacgcagcagtatcaggaaaaaatgaatccttacaccaaaggacttcctgtcgatgtagaaaaagcatgggaaaaccgttatctcgattttttcaaacttttcctaaaatatcatcagcatattgagcgtgtaactttttggggagtgagcgacatcgattcctggaaaaacgattttccgataagaggacgtaccgattatccactaccgtttaaccgtcaatatcaggcaaaacctttggttcagaaattaatagacttaacgaaatag

SEQ ID NO: 140 - protein, 380 aa, Unknown
  Obtained from an environmental sample
  SIGNAL (1)...(24)
MKKTIAHFTLWIVFFLFTSCTVTAQKNAKNARVKPTTLKEAYQGKFYIGTAMNLRQIHGDDPQSENIIKKQFNSIVAENCMKSMYLQPEEGKFFFDDADKFVDFGLQNNMFIIGHCLIWHSQAPKWFFTDENGNTVSPEVLKQRMKAHITAVVSRYKGKIKGWDVVNEAIMEDGSYRKSKFYEILGEEFIPLAFQYAHEADPDAELYYNDYNEWYPGKRAMVTKIIRDFKTRGIRIDAIGMQAHFGMDSPTVEEYEQTIQGYIKEGVKVNITELDLSPLPSPWGTSANVADTQQYQEKMNPYTKGLPVDVEKAWENRYLDFFKLFLKYHQHIERVTFWGVSDIDSWKNDFPIRGRTDYPLPFNRQYQAKPLVQKLIDLTK

SEQ ID NO: 141 - DNA, 1134 bp, Unknown
  Obtained from an environmental sample
atgaatatctcacgcagacaactactggcgctcacgggtgctacggcggcgatcacagcagccaaattacaggcggcagaaaaagccagcgccgcgaccggcttgcgcgatgcctacaaaaatgattttttgattggcgctgcgctgagtgcatcgatcattcaacagcaagatccacagctagttgcactgattaataaagactttaattccatcaccccagaaaactgtatgaaatggggcgagatgcgcaatgatgacggcagctggaagtggcaggatgcagacgcatttgtcgagtatggaagcaaatacaaactacatatggtcggccacacattggggtggcacagccagattcccgatagcgtgtttaaaaataaagacggtagctatatttccaaaaccgaactcgcgaaaaaacaaaaagaacacatcaccactattgttggccgctacaaaggcaaacttgccgcgtgggatgtggtgaatgaagctgtcggcgatgacaacaaaatgcgcgatagtcactggtataaaatcatgggcgatgattttctcgttaatgcatttaaccttgctcatgaagtagatccgaaggcgcatctgatgtacaacgactacaacaacgagcgcccggaaaaacgccaggcgactatcgatatgatcaagcgtctgcaacaacgcggtacaccaatccatggtttgggcatgcaagcgcatatcggattggaaaccaatatgcaggattttgaagatagtattctcgcctattcagcattgggtttaaaaatccatctcaccgaactagatatagatgtgctgccctctgtatggaatttaccggtggccgaaatttctacccgctttgaatacaagccggaacgcgatccttatacaaaaggtttgccgaaagagattgatgaaaaacttgcaaaagcctatgaatcgctatttaaaatattgcttaaacatcgcgacaaaatagatagagttacgttttggggcgtaagcgatgatgccagctggctcaatgatttcccaatcaatggcagaaccaactatccgttattgtttaaccgtcaacgccaacctaaagctgcttatttccgtttgctggatttaaaacgctag

SEQ ID NO: 142 - protein, 377 aa, Unknown
  Obtained from an environmental sample
  SIGNAL (1)...(25)
MNISRRQLLALTGATAAITAAKLQAAEKASAATGLRDAYKNDFLIGAALSASIIQQQDPQLVALINKDFNSITPENCMKWGEMRNDDGSWKWQDADAFVEYGSKYKLHMVGHTLGWHSQIPDSVFKNKDGSYISKTELAKKQKEHITTIVGRYKGKLAAWDVVNEAVGDDNKMRDSHWYKIMGDDFLVNAFNLAHEVDPKAHLMYNDYNNERPEKRQATIDMIKRLQQRGTPIHGLGMQAHIGLETNMQDFEDSILAYSALGLKIHLTELDIDVLPSVWNLPVAEISTRFEYKPERDPYTKGLPKEIDEKLAKAYESLFKILLKHRDKIDRVTFWGVSDDASWLNDFPINGRTNYPLLFNRQRQPKAAYFRLLDLKR

SEQ ID NO: 143 - DNA, 3285 bp, Bacteria
atgagtttaaaaataaataaaatcatatcatttatcatagttttttcgatggtttttgggacgttaatgtatgtgccacatctaaaagcatttgcggataataccggtattaatttggtttctaatggtgattttgaatcaggcacaattgatggctggtttaaacaaggtaatccgacattaacagtaacaactgagcaggcaattgggcaatacagtatgaaagttacaggtagaacacagacatatgaaggacccgcatatagctttttggggaaaatgcagaaaggtgaatcatataacgtatcacttaaagttagacttgtttctggacaaaattcatctaatcctttgatcactgtaactatgtttagagaagatgacaatggcaatcattatgacacaatagtttggcaaaaacaagtttctgaagattcatggactactgtaagtgggacttatacattggattatactggaacattaaaaacattatatatgtatgtagaatcacccgatccaacgcttgaatattatattgatgatgttgtagtcacaccgcaaaatccaacgcaaataggaaatgtagttgccaatggaacttttgaaaatgaaaatacttctggatgggttggaacaggttcatctgttgttaaagcagtatatggtgatgctcacagcggagattatagcttattgacgacaggaaggacagctaactggaatggtcctagttatgatttgactggcaaaatagttcccggacaacaatacaatgtggatttttgggtaaaatttattgatggcaatgatacagagcaaatcaaggctactgttaaagcgacttctgacaaagacaattatatacaagttaatgattttgcagatgtaagtaaaggtgaatggacagaaataaaaggcagttttactttacctgttgcagattacagcggcattagcatctatgtggaatctcaaaatcctactttagagttttacattgatgatttttctgtaataggtgaaattgcaaataatcagattactattcaaaatgacattccagatttgtactctgtatttaaagattattttcctataggcgttgcggttgatccaagtagattaaatgatactgatccgcatgctcaattgacggctaaacattttaatatgcttgttgcagaaaacgccatgaaacctgaaagtttacaacccacagaaggaaattttacttttgataatgctgataagattgttgattatgcaatatcacataatatgaagatgagggggcatactttactttggcataatcaagttccagattggtttttccaagatccgtctgacccatccaagcctgcttcgagagatttactattacaaagattaaaaactcatattacaactgtgttagaccattttaaaacaaagtatggttctcagaatccaataattggatgggatgtcgtaaatgaagttcttgatgataatggcagtttgagaaattcgaagtggttgcaaattattggacccgactatatagaaaaagcctttgaatatgcacatgaagcggatccatcgatgaagttgtttattaatgattacaatatcgaaaataatggcgttaaaactcaagctatgtatgacttggtaaaaagattaaagagtgaaggcgttcctatagatggaatagggatgcaaatgcacataaatataaattccaatatagataatataaaagcatcaatagaaaaactggcatcgttaggcgttgaaatacaagtaactgaattagatatgaacatgaacggtaatatatctaacgaagcattgctcaagcaagctagattgtataaacaattatttgacttatttaaagcagagaaacaatatataactgctgtagttttttggggagtttcagacgatgtaacttggcttagcaagccaaatgctccgctactttttgatacaaagttgcaagcaaagccagcatactgggcaatagtagatccgaataaagctacaccagacattcaatctgcaaaggctttggaaggatcaccgacaatgggtacaaatgttgataactcttggaaacttgtaaagccgttatatgcaaatacttttgtagaagggtcggtcggagcaactgctgctgttaagtctatgtgggatactaaaaacttgtatttgttagtacaagtttcagacaataccccatctagtaatgatggtattgagatttttgtagataagaatgatgacaaatccacttcttatgaaactgatgatgaacattatacaattaagagggatggtacagggagttcagatattaccaaatatgtgacttctaatgctgacggatatgtagcacagctagctattccaattgaagatattaatcctgcacttaatgataaaattggatttgacattagaataaatgatgataaaggtattggtaatatagatgcaataacagtttggaacgattatacaaacagtcaagatactaatacatcgtattttggcgatttagtattatcaaaacctgcacaaattgcaacagctatatatggcactcctgttattgatggtaaagtagatgatatttggaataatgttgaagctatttcaacaaatacatgggttttgggttcaaatggtgctactgcgacagcaaaaatgatgtgggacgataagtacctttatgttttggcggatgttacagattcaaatctgaacaaatctagtgttaatccatatgaacaagattctgtagaagtttttgtagatcaaaataatgacaagacgacatattataaaaatgatgatggacagtttagagttaactatgacaatgaacaaagctttgggggaagcactaattcaaatggatttaaatcggcaactagtcttacacaaagtggatatattgtagaagaagctattccttggacgagtatcactccatcaaatggcactatcataggatttgacttgcaagttaatgatgcagatgaaaatggtaagaggacaggtattgtaacatggtgtgatccgagcggaaattcatggcaagatacttctgggtttgggaatttattgcttacaggtaaaccatccggtgttggtacaaaaagaatggcgtttaacgacataaaagacagttgggcaaaagatgcaatagaagtattagcatcaaggcacatagtagaaggtatgacagacactcagtatgaaccaaacaagacagtaacgagagcggaataa

SEQ ID NO: 144 - protein, 1094 aa, Bacteria
  SIGNAL (1)...(32)
MSLKINKIISFIIVFSMVFGTLMYVPHLKAFADNTGINLVSNGDFESGTIDGWFKQGNPTLTVTTEQAIGQYSMKVTGRTQTYEGPAYSFLGKMQKGESYNVSLKVRLVSGQNSSNPLITVTMFREDDNGNHYDTIVWQKQVSEDSWTTVSGTYTLDYTGTLKTLYMYVESPDPTLEYYIDDVVVTPQNPTQIGNVVANGTFENENTSGWVGTGSSVVKAVYGDAHSGDYSLLTTGRTANWNGPSYDLTGKIVPGQQYNVDFWVKFIDGNDTEQIKATVKATSDKDNYIQVNDFADVSKGEWTEIKGSFTLPVADYSGISIYVESQNPTLEFYIDDFSVIGEIANNQITIQNDIPDLYSVFKDYFPIGVAVDPSRLNDTDPHAQLTAKHFNMLVAENAMKPESLQPTEGNFTFDNADKIVDYAISHNMKMRGHTLLWHNQVPDWFFQDPSDPSKPASRDLLLQRLKTHITTVLDHFKTKYGSQNPIIGWDVVNEVLDDNGSLRNSKWLQIIGPDYIEKAFEYAHEADPSMKLFINDYNIENNGVKTQAMYDLVKRLKSEGVPIDGIGMQMHININSNIDNIKASIEKLASLGVEIQVTELDMNMNGNISNEALLKQARLYKQLFDLFKAEKQYITAVVFWGVSDDVTWLSKPNAPLLFDTKLQAKPAYWAIVDPNKATPDIQSAKALEGSPTMGTNVDNSWKLVKPLYANTFVEGSVGATAAVKSMWDTKNLYLLVQVSDNTPSSNDGIEIFVDKNDDKSTSYETDDEHYTIKRDGTGSSDITKYVTSNADGYVAQLAIPIEDINPALNDKIGFDIRINDDKGIGNIDAITVWNDYTNSQDTNTSYFGDLVLSKPAQIATAIYGTPVIDGKVDDIWNNVEAISTNTWVLGSNGATATAKMMWDDKYLYVLADVTDSNLNKSSVNPYEQDSVEVFVDQNNDKTTYYKNDDGQFRVNYDNEQSFGGSTNSNGFKSATSLTQSGYIVEEAIPWTSITPSNGTIIGFDLQVNDADENGKRTGIVTWCDPSGNSWQDTSGFGNLLLTGKPSGVGTKRMAFNDIKDSWAKDAIEVLASRHIVEGMTDTQYEPNKTVTRAE

SEQ ID NO: 145 - DNA, 1629 bp, Eukaryote
atgaagattgtggatacaacttccgcagagataaagattgaaatggaacctgaaaaagagatacctgctctgaaagaagtactaaaagactacttcaaagtcggagttgcactgccgtccaaggtcttcctcaacccgaaggacatagaactcatcacgaaacacttcaacagcatcaccgcagaaaacgagatgaaaccggatagtctgctcgcgggcatcgaaaacggtaagctgaagttcaggtttgaaacagcagacaaatacattcagttcgtcgaggaaaacggcatggttataagaggtcacacactggtgtggcacaaccagacacccgactggttcttcaaagacgaaaacggaaacctcctctccaaagaagcgatgacggaaagactcaaagagtacatccacaccgttgtcggacacttcaaaggaaaagtctacgcatgggacgtggtgaacgaagcggtcgatccgaaccagccggatggactgagaagatccacctggtaccagatcatggggcctgactacatagaactcgccttcaagttcgcaagagaagcagatccagatgcaaaactcttctacaacgactacaacacattcgagcccagaaagagagatatcatctacaacctcgtgaaggatctcaaggagaagggactcatcgatgggataggcatgcagtgtcacatcagtcttgcaacagacatcaaacagatcgaagaggccatcaaaaagttcagcaccatacccggtatagaaattcacatcacagaactcgatatgagtgtctacagagattccagttccaactacccagaggcaccgaggacggcactcatcgaacaggctcacaaaatgatgcagctctttgagattttcaagaagtacagcaacgtgatcacgaacgtcacattctggggtctcaaggacgattactcctggagagcaacaagaagaaacgactggccgctcatcttcgacaaagatcaccaggcgaaactcgcttactgggcgatagtggcacctgaggtccttccaccacttccaaaagaaagcaggatctccgaaggcgaggctgtggtagtggggatgatggatgactcgtacctgatgtcgaagccgatagagatccttgacgaagaagggaacgtgaaggcaacgatcagggcggtgtggaaagacagcacgatctacatctacggagaggtacaggacaagacgaaaaaaccagcagaagacggagtggccatattcatcaacccgaacaacgaaagaacaccctatctgcagcctgatgacacctacgctgtgctgtggacaaactggaagacggaggtcaacagagaagacgtacaggtgaagaaattcgttgggcctggctttagaagatacagcttcgagatgtcgatcacgataccgggtgtggagttcaagaaagacagctacataggattcgacgctgcggtgatagacgacgggaagtggtacagctggagcgacacgacgaacagccagaagacgaacacgatgaactacggaacgctgaaactcgaaggaataatggtagcgacagcaaaatacggaacaccggtcatcgatggagagatagacgagtaa

SEQ ID NO: 146 - protein, 542 aa, Eukaryote
MKIVDTTSAEIKIEMEPEKEIPALKEVLKDYFKVGVALPSKVFLNPKDIELITKHFNSITAENEMKPDSLLAGIENGKLKFRFETADKYIQFVEENGMVIRGHTLVWHNQTPDWFFKDENGNLLSKEAMTERLKEYIHTVVGHFKGKVYAWDVVNEAVDPNQPDGLRRSTWYQIMGPDYIELAFKFAREADPDAKLFYNDYNTFEPRKRDIIYNLVKDLKEKGLIDGIGMQCHISLATDIKQIEEAIKKFSTIPGIEIHITELDMSVYRDSSSNYPEAPRTALIEQAHKMMQLFEIFKKYSNVITNVTFWGLKDDYSWRATRRNDWPLIFDKDHQAKLAYWAIVAPEVLPPLPKESRISEGEAVVVGMMDDSYLMSKPIEILDEEGNVKATIRAVWKDSTIYIYGEVQDKTKKPAEDGVAIFINPNNERTPYLQPDDTYAVLWTNWKTEVNREDVQVKKFVGPGFRRYSFEMSITIPGVEFKKDSYIGFDAAVIDDGKWYSWSDTTNSQKTNTMNYGTLKLEGIMVATAKYGTPVIDGEIDE

SEQ ID NO: 147 - DNA, 1146 bp, Unknown
  Obtained from an environmental sample
atgactttctctcgacggcaatttttgctgcaaacctccgccggcctggcacttttgagcactgccaaaatgcgcgctttcgcccgcgcagtcgatgaagtgggccttaaagaccattttaaagaccattttcatattgggactgccatcagcggtcgactgatgacggaaatgccggccttttaccgcgacctggttacccgtgaattcagtgccattaccatggaaaacgacatgaaatgggagcgtctgcatcccaaagaaggccaatgggattgggagattgccgacaaattcgtcaattttggcgaagaaaacgacatgtacattgtcgggcatgttctggtctggcactcacagaccccggattgggtgttccaggattccagaggcaagcccatttctcgcgacgctttgctgaaacgcatgcgccaccagattgaacagatggcgggccgctataagggccgggtacacgcgtgggatgtggtcaatgaggcggtggacgaggaccaaggctggcgcaaaagcccgtggtttaacattattgggcccgagtttatggagcacgccttcaattacgcccacgaagtggaccccgacgctcacctgttgtacaacgactacaatatgcacggtcgggaaaaacgcgaattcgtcctggatttcatcaaaagatacaagaaaaaaggcattccgatccagggcataggcatgcaaggccatgtgggcctgagctttcccgatatcagcgagtttgagaaaagcctgcaagcctacgccaaacagggcatgcggatgcacattaccgagctggatatggacgtgttaccagtggcctgggatcacattggcgccgagatttccaccgagtttgactacgctgatgaactggacccctggcccaaagggctgccggaagaagtcgaacaggaatttaccgatcgctacaccgctttctttaaactgtttttgaaataccgcgatgatattgaaagggtcaccttctggggaaccggagatgcggaatcgtggaaaaataatttcccagtaagggggcgcaccaactacccgctgctgtttgatcgccgataccgcagaaaaccggcctatgattcgattgtcgaactgaccaaaaacctttaa

SEQ ID NO: 148 - protein, 381 aa, Unknown
  Obtained from an environmental sample
  SIGNAL (1)...(28)
MTFSRRQFLLQTSAGLALLSTAKMRAFARAVDEVGLKDHFKDHFHIGTAISGRLMTEMPAFYRDLVTREFSAITMENDMKWERLHPKEGQWDWEIADKFVNFGEENDMYIVGHVLVWHSQTPDWVFQDSRGKPISRDALLKRMRHQIEQMAGRYKGRVHAWDVVNEAVDEDQGWRKSPWFNIIGPEFMEHAFNYAHEVDPDAHLLYNDYNMHGREKREFVLDFIKRYKKKGIPIQGIGMQGHVGLSFPDISEFEKSLQAYAKQGMRMHITELDMDVLPVAWDHIGAEISTEFDYADELDPWPKGLPEEVEQEFTDRYTAFFKLFLKYRDDIERVTFWGTGDAESWKNNFPVRGRTNYPLLFDRRYRRKPAYDSIVELTKNL

SEQ ID NO: 149 - DNA, 1044 bp, Unknown
  Obtained from an environmental sample
atgaagaagctttttgtcgcggtcgttttgttgcccttagcaacttttttcgcgtcggacggattggagggagaacctttgagatcgttagccgagaaacttggcatctacatcggttacgcttcgatcaaccatttctggactcttccggattcaaacaagtacacagaagtggcaaagagggagttcaacatactcacgccagagaaccaaatgaagtgggacagccttcacccagagcctgacaggtacaacttcacttacgcagagcgtcatgtcgagttcgctttggaaaacaacatgctcgttcacggccacacactcgtttggcacaaccaacttccgttctggttgaacagacagtggaccaaagaagaactcctgaaagtccttgaggaccacatcaaaacagtcgtcggtcacttcaaaggaagggtgaagatttgggacgtggtgaacgaagcggtcagcgacatgggcagttacagagagaccatttggtacaagaccatcggacccgagtacatcgaaaaggcattcgtgtgggcaagacaagccgatccggaagcgatcctcatatacaacgactacaatatagaaacgatcaatcccaaatcgaatttcacctaccagctcatcaaggagctgaaagaaaaaggtgtgccgatagacggcatcggttttcaaatgcacatagacatcaacggaataaactatgacagtttcagaaacaacctgaagaggttcgctgatctcggtctgaagctctacatcacggaaatggatgtgagaatacccaagaacgcaactgaaaaagacttggacagacaggcagaaatctacgcgaagatcttcgaaatctgcttagagaatcctgcggtccaagccatacagttctggggtttcacggacaagtattcctgggtgcctggctttttcagcgggtacgatcatgcgctgatctttgacagggactacagccccaagcccgcgtattttgcgataaagagggtgctcgaagccaaggtgagcaagggacgctga

SEQ ID NO: 150 - protein, 347 aa, Unknown
  Obtained from an environmental sample
  SIGNAL (1)...(18)
MKKLFVAVVLLPLATFFASDGLEGEPLRSLAEKLGIYIGYASINHFWTLPDSNKYTEVAKREFNILTPENQMKWDSLHPEPDRYNFTYAERHVEFALENNMLVHGHTLVWHNQLPFWLNRQWTKEELLKVLEDHIKTVVGHFKGRVKIWDVVNEAVSDMGSYRETIWYKTIGPEYIEKAFVWARQADPEAILIYNDYNIETINPKSNFTYQLIKELKEKGVPIDGIGFQMHIDINGINYDSFRNNLKRFADLGLKLYITEMDVRIPKNATEKDLDRQAEIYAKIFEICLENPAVQAIQFWGFTDKYSWVPGFFSGYDHALIFDRDYSPKPAYFAIKRVLEAKVSKGR

SEQ ID NO: 151 - DNA, 1131 bp, Unknown
  Obtained from an environmental sample
atgcgatctatgccactttatgtgttgttatgcagcgcccttctgaccggcagcctatatgcacaagaccaaaatgcttctttaaaacaggcctttagcaaaaactttagtattggcacagccttaagtgctacacaaattcagggcaaagagccgggcacactggaattggtaacacagcaatttaacgcggtgacggcagaaaacgtgatgaagtgggaaatcattgaacctgtggaaggccagttcaactttgctgccgccgacgccatgattgaattcgccgaagccaatcatatcaaggtgataggccatgtgctgttatggcacgaacaaacaccagcctgggtatttctggacgccaaaggccaggccgcctcaaaggaactggtgttatcacggctaaaaaaccatatcaatgccgtaatgggccgctacaaaggccgtattcatggctgggatgcagtcaacgaagccttaaatgaagacggcactctgcgccaatccaactggtataaagctttaggcgacgactatatagccacagtctttgaactggcgcatcaggccgacccgaaagccgaactctattacaacgacttcaatttatttaaaccggaaaaacgcgctggtgtactcaaactggtggcagctttaaaagcgaaaaatgtgcctatccacggcataggcgagcaaggccattacagcctggattaccctgagctgcagcaagtagaagactctattgtggcttttaaaaacactggcctgaaagtggtgattaccgaactggatatctcagttttacccttccctgagccagaaaagattggtgctgatatctcactcaatatgcagttaaaacaagaacttaatccctacgccgatggcttacccaaagaagtcagcgatcaactgacagaaaaatacctgcaattatttcagctatttttacgccacagcgacgccatcgaacgcgtgaccttatggggcgtaaacgacaaccaaacctggcgcaacaactggccaatgaaaggcagaacagactaccccttactcttcgaccggaaaaaccagccaaaagaagtggttcctgcattgattaaactggcggaaaaagctggtaaataa

SEQ ID NO: 152 - protein, 376 aa, Unknown
  Obtained from an environmental sample
  SIGNAL (1)...(21)
MRSMPLYVLLCSALLTGSLYAQDQNASLKQAFSKNFSIGTALSATQIQGKEPGTLELVTQQFNAVTAENVMKWEIIEPVEGQFNFAAADAMIEFAEANHIKVIGHVLLWHEQTPAWVFLDAKGQAASKELVLSRLKNHINAVMGRYKGRIHGWDAVNEALNEDGTLRQSNWYKALGDDYIATVFELAHQADPKAELYYNDFNLFKPEKRAGVLKLVAALKAKNVPIHGIGEQGHYSLDYPELQQVEDSIVAFKNTGLKVVITELDISVLPFPEPEKIGADISLNMQLKQELNPYADGLPKEVSDQLTEKYLQLFQLFLRHSDAIERVTLWGVNDNQTWRNNWPMKGRTDYPLLFDRKNQPKEVVPALIKLAEKAGK

SEQ ID NO: 153 - DNA, 1020 bp, Unknown
  Obtained from an environmental sample
atgggtgctatgggcctggcggcgctgtattcgctgccagccaatgcacagacctgcattacgcagagtcagacgggcaccaacaacggccactatttttcgttctggaaggacaatccgggaacggtcaatttctgtatgtatgccaacggccgttacacgtctaactggaacggcatcaacaattgggtcggcggcaaaggctggcaaaccggctcgcgcagaaacgtcacctactctggctcgttcaactctcccggcaatggctatctggctgctctactggctggaccaccaatcctgttggtcgagtactacatcatcgagagctggggaaattggcgcccgccgggttcggatggaacattgttaggcaccgtcactagcgacggcggtacttacgatatctatcgctcgcgccgcaccaacgcgccttgtatcactggcaactcctgtaacttcgatcagtactggagcgtacggcaatccaagcgcgtgggcggcacgattaccacgggcaatcacttcgacgcttgggcggcacgcggcttgaacctcggcacgcacaactaccaagtgatggcgaccgagggatatcagagcaacggcagctccgacatcaccattagcgacaacccgggaccgacgccaggacccactccgaacccgaatcccacgccgggcaccaagaatttcacggtgcgcgcgcgcggaaccgcggggggtgagtccatcacgctgcgtgtgaacaatcagaacgtgcagacctggacgctgtcgaccagctaccagaacttcacggcgtccacgacgttgagtggtggcatcacggtcgcgttcaccaatgatggtggtagtcgagacgttcaggtggattacatccaggtgaacggcgcaactcgacaatccgagagccagacgtacaacaccggcctctatgccaacggcagttgcggcggcggctcgaacagcgagtggatgcattgcaatggagcgatcggctacggcaacacgccgtag

SEQ ID NO: 154 - protein, 339 aa, Unknown
  Obtained from an environmental sample
  SIGNAL (1)...(16)
MGAMGLAALYSLPANAQTCITQSQTGTNNGHYFSFWKDNPGTVNFCMYANGRYTSNWNGINNWVGGKGWQTGSRRNVTYSGSFNSPGNGYLAALLAGPPILLVEYYIIESWGNWRPPGSDGTLLGTVTSDGGTYDIYRSRRTNAPCITGNSCNFDQYWSVRQSKRVGGTITTGNHFDAWAARGLNLGTHNYQVMATEGYQSNGSSDITISDNPGPTPGPTPNPNPTPGTKNFTVRARGTAGGESITLRVNNQNVQTWTLSTSYQNFTASTTLSGGITVAFTNDGGSRDVQVDYIQVNGATRQSESQTYNTGLYANGSCGGGSNSEWMHCNGAIGYGNTP

SEQ ID NO: 155 - DNA, 1836 bp, Unknown
  Obtained from an environmental sample
atgaaaggattaattgcggcagcgcttgctggcttggcattcggggcctccctatcctggggacagtgcacaacgtttaccaccagtaccattcagaattgtaatggcattgattacgagctctggagtcagaataacaagggcaccgtaagcatgaagattacgggagggagcacgaatccgaatggaggaactttcgatgctacctggaatggcaccgagaatatcctggctagagctggtaagaaatggggctcgtccagcactaccacccccacgtccgcaggcaatattactcttgaattcgcggcgacatggtcctcaagcgataacgtaaaaatgcttggagtctatggctgggcgtactatccaactggaagtatcccgactaaacaggaaaatggagcaagtacctcattcacaaatcaaattgagtactacatcatccaggatcgtggtagctataatgctgcatcgggtggaacgaactccaaaaaatacggcgaagggacgatcgatggaattctgtatgaattctatatcgcagacagaatcaaccagcctgatctgtcaggaaagagtggaaacttcaagcaatacttcagcgtcccgaaaagtacgagcagccataggcaaagtgggacgattaccgtttccaaacatttccaggcctgggaaaatgccggaatgaaaatgatgtcctgtcgcttgtatgaagtcgcaatgaaagtcgagtcctataccggttctgcgaccggtgttggctctgcgaaggttacaaagaatatactcaccattggtggaatcttgagcagtagcagtactgcaagcagtagcagcacagtaagtagcagtagcagcaatgcatatacgcttgtcacgaatgtttctcccgctggagccggaacagtgaccaggagccccaatactgcgacctatgccccgaatgcttcagtacagcttactgcaacgccgagtaccggttggaaatttgtcggttgggctggggatcttacgtcaactacgagtactgctaccgtcaccatgaccaaagatattaccgcaactgcaaaatttgaactggtatcgggagatggcacgaccaacttgatcaaggatggaaacttccccagtagcagcgtcatctccacaggtgatggcacctcctggaagctcgggcaaggtacaaactggggtaattccgcagcaacgacgagtgtcagcaatggaatcgcgactgtcaatgtgaccaccattggatctcaaacctatcaaccccagctaattcagtataacgtggctctttacaaggatatgagctacaagctcaccttcaaggcaaaagctgctgctgcaaggaaaattgaagtcgcattccaacagtcggtggacccatgggctggatatgcttccaaggaattcgatcttacaacgacagagcagacatatgagttcgtatttaaaatgactagcgctactgacacggcttcacagttcgcgttcaatctcggccaggcaacaggcgccgtcaatattagtgatgtaaagctagtatatacgacagctggtacaacacccgtattccgtggatataatgaggcggcaacacaggagaggcctgtattcatatccttggatggtaggacgttgaacattgttccagtgtatggagccaaactgcaggtcaagttagtggacatcaatggtaagatgagagcctccttcaatgtggtcggaattgcttccatcccgctgtccaatatccccgctgggcggtattatattgacgtaagtggtgacggcgttaagcaggcatccccgatagttctggaataa

SEQ ID NO: 156 - protein, 611 aa, Unknown
  Obtained from an environmental sample
  SIGNAL (1)...(21)
MKGLIAAALAGLAFGASLSWGQCTTFTTSTIQNCNGIDYELWSQNNKGTVSMKITGGSTNPNGGTFDATWNGTENILARAGKKWGSSSTTTPTSAGNITLEFAATWSSSDNVKMLGVYGWAYYPTGSIPTKQENGASTSFTNQIEYYIIQDRGSYNAASGGTNSKKYGEGTIDGILYEFYIADRINQPDLSGKSGNFKQYFSVPKSTSSHRQSGTITVSKHFQAWENAGMKMMSCRLYEVAMKVESYTGSATGVGSAKVTKNILTIGGILSSSSTASSSSTVSSSSSNAYTLVTNVSPAGAGTVTRSPNTATYAPNASVQLTATPSTGWKFVGWAGDLTSTTSTATVTMTKDITATAKFELVSGDGTTNLIKDGNFPSSSVISTGDGTSWKLGQGTNWGNSAATTSVSNGIATVNVTTIGSQTYQPQLIQYNVALYKDMSYKLTFKAKAAAARKIEVAFQQSVDPWAGYASKEFDLTTTEQTYEFVFKMTSATDTASQFAFNLGQATGAVNISDVKLVYTTAGTTPVFRGYNEAATQERPVFISLDGRTLNIVPVYGAKLQVKLVDINGKMRASFNVVGIASIPLSNIPAGRYYIDVSGDGVKQASPIVLE

SEQ ID NO: 157 - DNA, 645 bp, Unknown
  Obtained from an environmental sample
atgtttaagttaagtaagaaaattttgatggtgttattaacaatttcaatgagttttattagcttatttgcagtaaccgcgtatgcagcttcgacagactactggcaaaattggactgatggtggtgggacagtaaatgctaccaatggatctgatggcaattacagtgtttcatggtcaaattgcgggaattttgttgttggtaaaggctggactaccggatcagcaactagggtaataaactataatgccggagccttttcgccgtccggcaatggatatttagctctttatgggtggacgagaaattcactcatagaatattacgtcgttgatagctgggggacttatagacctactggaacttataaaggcactgtgactagtgatggagggacatatgacatatacacgactacacgaaccaacgcaccttccattgacggcaataatacaaatttcacccagttctggagtgttaggcagtcaaagagaccgattggtaccaacaataccatcacttttagcaaccacgttaacgcctggaagagtaaaggaatgaatctggggagtagttgggcttatcaggtattagcgacagagggatatcaaagtagtgggtactctaacgtaacggtctggtaa

SEQ ID NO: 158 - protein, 214 aa, Unknown
  Obtained from an environmental sample
  SIGNAL (1)...(29)
MFKLSKKILMVLLTISMSFISLFAVTAYAASTDYWQNWTDGGGTVNATNGSDGNYSVSWSNCGNFVVGKGWTTGSATRVINYNAGAFSPSGNGYLALYGWTRNSLIEYYVVDSWGTYRPTGTYKGTVTSDGGTYDIYTTTRTNAPSIDGNNTNFTQFWSVRQSKRPIGTNNTITFSNHVNAWKSKGMNLGSSWAYQVLATEGYQSSGYSNVTVW

SEQ ID NO: 159 - DNA, 1041 bp, Unknown
  Obtained from an environmental sample
atgatcagtctcaaacgagtggcggcgctcctgtgcgtcgcaggtctgggcatgtctgcggcaaacgcgcagacctgcctcacgtcgagtcaaaccggcactaacaatggcttctattattccttctggaaggacagtccgggcacggtgaatttttgcctgcagtccggcggccgttacacatcgaactggagcggcatcaacaactgggtgggcggcaagggatggcagaccggttcacgccggaacatcacgtactcgggcagcttcaattcaccgggcaacggctacctggcgctttacggatggaccaccaatccactcgtcgagtactacgtcgtcgatagctgggggagctggcgtccgccgggttcggacggaacgttcctggggacggtcaacagcgatggcggaacgtatgacatctatcgcgcgcagcgggtcaacgcgccgtccatcatcggcaacgccacgttctatcaatactggagcgttcggcagtcgaagcgggtaggtgggacgatcaccaccggaaaccacttcgacgcgtgggccagcgtgggcctgaacctgggcactcacaactaccagatcatggcgaccgagggctaccaaagcagcggcagctccgacatcacggtgagtgaaggcggtagcagcagtggtggcggaagcagcacgagcagcagcagcggcggtggtggcaccaagagcttcacggttcgtgcgcgcggtaccgcgggcggtgagtccatcacgctgcgcgtgaacaaccagaacgtgcagacctggacgctgggcaccagcatgacgaactacacggcgtcgacttcactgagcggcggcatcaccgtggtgtacacgaacgacagcggtaaccgcgacgtgcaggtggactacatcgtcgtgaacggccagacgcgccagtccgaagcccagagctacaacaccggcctttatgcgaacgggcgttgcggcggtggctccaacagcgaatggatgcattgcaacggcgccatcggctacggcaatacaccgtaa

SEQ ID NO: 160 - protein, 346 aa, Unknown
  Obtained from an environmental sample
  SIGNAL (1)...(23)
MISLKRVAALLCVAGLGMSAANAQTCLTSSQTGTNNGFYYSFWKDSPGTVNFCLQSGGRYTSNWSGINNWVGGKGWQTGSRRNITYSGSFNSPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSEGGSSSGGGSSTSSSSGGGGTKSFTVRARGTAGGESITLRVNNQNVQTWTLGTSMTNYTASTSLSGGITVVYTNDSGNRDVQVDYIVVNGQTRQSEAQSYNTGLYANGRCGGGSNSEWMHCNGAIGYGNTP

SEQ ID NO: 161 - DNA, 1047 bp, Unknown
  Obtained from an environmental sample
atgttcaaaggtcttttgaaatcggtcctcaccggcaagcgagccggtgcggtgttcatctgtctggccggactgtggatgacacaggcgcaggcgcagacgtgcatcggttcaccacaaacgggcaacaacggcggcttcttcttttcgttctggaaagacaatccggggtcggtgaatttctgcatgtactccggcggtcgctatacctccagctggagcggcatcaacaactgggtaggtgggaagggctggcaaaccggttcatcccgcacggtgacgtattcgggcacgttcaactcgccgggaaacggctacctgactctgtacggatggaccaccaatccgctggtcgagtactacatcgtggacagctggggcagctaccgtccgcctggaggccagggcttcatgggcacggtcaccagcgacggcggaacgtatgacatctaccgggttcgccgcaccaatgcgccgtgcatcacaggcaacaactgcaacttcgaccagtactggagcgtgcgtcagtcgaggcgggtgggcggcaccatcaccaccgccaaccatttcaacgcgtggcgtacgctcggcatgaatctcgggcagcacaactaccaggtgatggcgaccgaaggattccagagcagtggcagctcggacatcaccgtgagcgaaggatctggcggtggcggcggaggtggcggcggtggcaccaagagcttcacggtgcgcgcgcgcggcaccgcgggcggcgagtccatcacgctgcgcgtcaacaaccaggtcgtgcagagctggaccttgagcaccagcatgcagaactacacggcctcgaccacgatgagcggcggcatcacggtgaacttcaccaacgacggcaccaaccgcgacgtgcaggtggactacatcatcgtgaatggccagacgcgtcagtccgaagcgcagacgtacaacaccgggctgtacgccaacggccgttgcggtggcgggtcgaacagcgagtggatgcattgcaatggcgcgatcgggtacggcgacacgccctga

SEQ ID NO: 162 - protein, 348 aa, Unknown
  Obtained from an environmental sample
  SIGNAL (1)...(32)
MFKGLLKSVLTGKRAGAVFICLAGLWMTQAQAQTCIGSPQTGNNGGFFFSFWKDNPGSVNFCMYSGGRYTSSWSGINNWVGGKGWQTGSSRTVTYSGTFNSPGNGYLTLYGWTTNPLVEYYIVDSWGSYRPPGGQGFMGTVTSDGGTYDIYRVRRTNAPCITGNNCNFDQYWSVRQSRRVGGTITTANHFNAWRTLGMNLGQHNYQVMATEGFQSSGSSDITVSEGSGGGGGGGGGGTKSFTVRARGTAGGESITLRVNNQVVQSWTLSTSMQNYTASTTMSGGITVNFTNDGTNRDVQVDYIIVNGQTRQSEAQTYNTGLYANGRCGGGSNSEWMHCNGAIGYGDTP

SEQ ID NO: 163 - DNA, 1068 bp, Unknown
  Obtained from an environmental sample
atgaaagcaaagagaatgaagttgtttgccgcatttttactctgttttacgcttgcacttcctggggcagtgcatgcgcagacgatcaccagcaattcggtcggtacgcatgacggttatgactatgaatactggaaggacagcgggaatggaactatggttctcggtagtggcggtacgttcagtgccgagtggagcaatatcaataatattctgttccgtaaaggcaagaagttcaatgagacgcagacccatcagcaaattggaaacatttccataacctatggtgccacctaccaaccgaatggcaattcgtatttaacggtctatggctggacggttgaccccctcgtcgaatattacattgtcgatagctggggcagctggcgtccgcctggagcatcgccaaaggggactgttaacgttgacggaggaacgtatgacatttatgagacaactcgtgtcaaccagccttccattaaaggcacggcaaccttcaagcagtattggagtgtccggacgtcaaaacggacgagcggaaccatatctgtaagcgagcactttaaggcctgggagaaattggggatgaccatgggcaagatgtatgaagtcgcgcttacggttgaaggctatcaaagcagtggaagcgctaatgtgtatagccatacactgacgatcggcgggggaacaacacctccaccaaccacaggcacaaagatcgaagccgagagtatgaccaaaagcggacaatacactgggaatatcagctcgccgttcaacggagtcgctttgtatgccaacaatgattccgtgaaattcacgcataatttcacgaccggcacccataacttctcactccggggggcatcaaacaactccaatatggcccgggttgacctgaaaatcggcgggcagacgaaggggaccttctatttcggcggaagcagccctgcggtctatactctgaataatgtcagccatggaaccggaaatcaagaggttgaactcgttgtaaccgccgataacggaacatgggatgctttcattgattatctcgagatccattaa

SEQ ID NO: 164 - protein, 355 aa, Unknown
  Obtained from an environmental sample
  SIGNAL (1)...(26)
MKAKRMKLFAAFLLCFTLALPGAVHAQTITSNSVGTHDGYDYEYWKDSGNGTMVLGSGGTFSAEWSNINNILFRKGKKFNETQTHQQIGNISITYGATYQPNGNSYLTVYGWTVDPLVEYYIVDSWGSWRPPGASPKGTVNVDGGTYDIYETTRVNQPSIKGTATFKQYWSVRTSKRTSGTISVSEHFKAWEKLGMTMGKMYEVALTVEGYQSSGSANVYSHTLTIGGGTTPPPTTGTKIEAESMTKSGQYTGNISSPFNGVALYANNDSVKFTHNFTTGTHNFSLRGASNNSNMARVDLKIGGQTKGTFYFGGSSPAVYTLNNVSHGTGNQEVELVVTADNGTWDAFIDYLEIH

SEQ ID NO: 165 - DNA, 1047 bp, Unknown
  Obtained from an environmental sample
gtggggcgcaggagcgccgccacggcattcatcggcctggcagcgctgtgtgcctcggccgccaacgcgcagacctgtctgagctcgagtcagaccggcaccaacaacggcttctactattcgttctggaccgacggcggtggctccgtgcagttctgcctgcaatccgccgggcgctacacctccagctggagcaatgtcggaaactgggtcggtggcaagggctggcagaccggcgcgcgccgcaacatcaactattccggcagcttcaatccctcgggtaacgcgtacctggccgtctatggctggaccacgaatcccctggtggagtactacatcgtcgacaactggggtacctatcgtccaccgggtgggcagggattcatgggcacggttgtcagcgatggcggcacctacgacgtctaccgcacgcaacgggtcaacgcgccctccattcagggcaacgcgaccttctaccagtactggagcgttcgccagtcgaagcgcaccggtggaaccatctccaccggcaaccatttcgacggctgggcgacgttcggcatgaacctgggaaccttcaattaccagatcgtggcgaccgagggctaccagagcagcggcaattccgacatcacggtgagcgatggcggcagcagctcctcgtcctccagcagcagcagttcgtcgtcctccagcagcggcggtggcggcaccaagagcttcacggtgcgcgcgcgcggcacggccggaggcgagtcgatcagcctgcgggtcaacaacaccaacgtgcagacctggtcgctgaccaccagctaccagaatctcacggcctcgaccacgctgaccggcggcatcaccgtcaactacaccaacgacagcagcggtcacgacgtacaggtggactacatcatcgtgaacggccagacccgccagtccgaggcgcagagctacaacaccggactctatgccaacgggcgctgcggtggtggtggctacagcgagtggatgcattgcaacggcgccatcggctacggcaatacgccgtaa

SEQ ID NO: 166 - protein, 348 aa, Unknown
  Obtained from an environmental sample
  SIGNAL (1)...(23)
VGRRSAATAFIGLAALCASAANAQTCLSSSQTGTNNGFYYSFWTDGGGSVQFCLQSAGRYTSSWSNVGNWVGGKGWQTGARRNINYSGSFNPSGNAYLAVYGWTTNPLVEYYIVDNWGTYRPPGGQGFMGTVVSDGGTYDVYRTQRVNAPSIQGNATFYQYWSVRQSKRTGGTISTGNHFDGWATFGMNLGTFNYQIVATEGYQSSGNSDITVSDGGSSSSSSSSSSSSSSSSGGGGTKSFTVRARGTAGGESISLRVNNTNVQTWSLTTSYQNLTASTTLTGGITVNYTNDSSGHDVQVDYIIVNGQTRQSEAQSYNTGLYANGRCGGGGYSEWMHCNGAIGYGNTP

SEQ ID NO: 167 - DNA, 669 bp, Unknown
  Obtained from an environmental sample
gtgaagctgaaaagactgttcaagatcggactgctgccggccgtattgttgtttagtgcaacgcagcagttaaccgcgcaaaccatctgcagcaaccagaccggcaccaacaacggctacttctactcgttctggaaggacaccgggtcggcgtgcatgacactgggttccggcggcaactacagcgtcaactggaacctgggttccgggaacatggtctgcggcaaaggctggagtaccggatcttcaagccgcagaatcggctacaacgccggcgtctgggcgccgaacggcaatgcctacctgactctgtatgggtggaccaggaacccgctcatcgagtactacgtggtcgacagttggggaagctggaggccgccaggcggaacctccgcgggcaccgtcaatagcgatggcgggacctacaacctctatcggacgcagcgggtcaacgcgccttccatcgacggcacccggacgttctatcagtactggagtgtccggacctcgaagaggcccaccgggagcaaccagaccatcaccttcgcgaaccacgtgaatgcgtggaggagcaaagggtggaatctggggagtcacgtctaccagataatggcaacagagggatatcaaagcagcgggaattccaacctgacggtgtgggcgcagtag

SEQ ID NO: 168 - protein, 222 aa, Unknown
  Obtained from an environmental sample
  SIGNAL (1)...(36)
VKLKRLFKIGLLPAVLLFSATQQLTAQTICSNQTGTNNGYFYSFWKDTGSACMTLGSGGNYSVNWNLGSGNMVCGKGWSTGSSSRRIGYNAGVWAPNGNAYLTLYGWTRNPLIEYYVVDSWGSWRPPGGTSAGTVNSDGGTYNLYRTQRVNAPSIDGTRTFYQYWSVRTSKRPTGSNQTITFANHVNAWRSKGWNLGSHVYQIMATEGYQSSGNSNLTVWAQ

SEQ ID NO: 169 - DNA, 1041 bp, Unknown
  Obtained from an environmental sample
atgattgttagtttcaagagcgtgaaggcactcgcgtgcctcgccgtgctcggcattaccgccgcgcaggcgcaaacctgcatcacttccagccagaccggtaccaacaacggcaactacttttccttctggaaggacagcccgggtaccgtcaacttctgcatgtatgccaatgggcgctacacctccaactggagcggcatcaacaactgggtgggcggcaagggctggcagacgggctccaaccgcacggtgacctactccggttcgttcaattcgcccggcaatggctatctcaccttgtacggatggaccacgaatccattgatcgagtactacatcgtcgacagctggggcacctatcgaccgccgggcggccagggcttcatgggcaccgtcaacagcgatggcggcacctatgacatctaccgcacgcagcgcgtgaaccagccttccatcatcggcaccgccacgttctaccagtactggagcgtgcggcagtcgaagcgcgtcggcggcacgatcaccacggccaaccacttcaacgcctgggccacgctgggcatgaacctgggccagcacaactaccaggtcatggccaccgagggttaccagagcagtggcagctccgacatcaccgtgaccgagggcggcggctcctcgtcgtccagtggcggcggcagcaccagcagtggcggtggcggcagcaagagcttcaccgtgcgtgcgcgcggcacggtcggcggcgaaaacatccagctgcaggtcaacaaccagacggtggcgagctggaacctgaccaccagcatgcagaactacaacgcctcgaccagcctgagtggcggcatcaccgtcgtgtacaccaatgacagcggcagccgcgacgtgcaggtggactacatcgtcgtcaacggccagacccgccagtccgaagcccagagctacaacaccgggctctatgccaacggacgttgtggtggcggctcgaacagcgagtggatgcattgcaacggcgcgattggctacggcaacacgccctag

SEQ ID NO: 170 - protein, 346 aa, Unknown
  Obtained from an environmental sample
  SIGNAL (1)...(24)
MIVSFKSVKALACLAVLGITAAQAQTCITSSQTGTNNGNYFSFWKDSPGTVNFCMYANGRYTSNWSGINNWVGGKGWQTGSNRTVTYSGSFNSPGNGYLTLYGWTTNPLIEYYIVDSWGTYRPPGGQGFMGTVNSDGGTYDIYRTQRVNQPSIIGTATFYQYWSVRQSKRVGGTITTANHFNAWATLGMNLGQHNYQVMATEGYQSSGSSDITVTEGGGSSSSSGGGSTSSGGGGSKSFTVRARGTVGGENIQLQVNNQTVASWNLTTSMQNYNASTSLSGGITVVYTNDSGSRDVQVDYIVVNGQTRQSEAQSYNTGLYANGRCGGGSNSEWMHCNGAIGYGNTP

SEQ ID NO: 171 - DNA, 678 bp, Unknown
  Obtained from an environmental sample
atggagttgaaaaaaatatccagaaaaggactgccactagtattcttgtccttgttgttgttcagtgtaacgcagcagtcaaacgcccaaaccatctgcagcaatcaaactggcacaaacaacggtttcttctattcgttttggaaggacaccggatcagcatgcatgactttgggctctggcggcaattacgacgtaagttggaatctgggttctgggaatatggttgtcggcaaaggctggagtaccggatcatcaaccaggagagtaggctacaatgccggcatctggcagccgaacggcaatgcatatttggctctctatgggtggacgagaaacccacttatagaatattacgtcgttgatagctggggcactttcaggccgcctggaggaacgtcaataggctccgtcaccactgatggtggtacataccaaatatatcggacccagcgagtcaacgcgccttccattgacggcgccagaactttttatcagtactggagtgtccggacctcgaagagaccgaccgggagcaaccaaaccatcacctttgcgaatcacgttaacgcgtggaggaatctaggtttgaatctggggagtcatgtttaccagataatggccacagagggatttcatagcagtgggagatctaacctaacggtgtggtcacagtaa

SEQ ID NO: 172 - protein, 225 aa, Unknown
  Obtained from an environmental sample
  SIGNAL (1)...(29)
MELKKISRKGLPLVFLSLLLFSVTQQSNAQTICSNQTGTNNGFFYSFWKDTGSACMTLGSGGNYDVSWNLGSGNMVVGKGWSTGSSTRRVGYNAGIWQPNGNAYLALYGWTRNPLIEYYVVDSWGTFRPPGGTSIGSVTTDGGTYQIYRTQRVNAPSIDGARTFYQYWSVRTSKRPTGSNQTITFANHVNAWRNLGLNLGSHVYQIMATEGFHSSGRSNLTVWSQ

SEQ ID NO: 173 - DNA, 1503 bp, Unknown
  Obtained from an environmental sample
ttgaaaaaactcgcagctgccttatcacttgcaattacctttgccgtaccgacaatagtacaagcacaaggtcccacatggactaccagcacaatacagaaatacaacaactacgactatgaactctggaatgaaaacaatcagggtaccgtttccatgaagctcacaggagataacggtaccgctgccaatgcggtaggcggaacgtttgagtctacttggagtggtacaaagaatgtgcttttccgttccggcagaaagtttaccggtacttcagggcaaagcgttgatggtggcggtgctggcaaaaccgctagtgcttacggcaatataagcattaacttcgccgctacgtggtcttccggtgacgatgtgaagatgcttggcgtatatggttgggcgttttacgcactgccaagtgtaccagacaaacaggaaaacggcacttctactaatttttccaatcaaatagaatactacatcattcaagaccgcggcagctataactcggctacaggtggcaccaactcaaagaaatacggtgaggctaccattgacggcattgcttatgagttccgtgtatgtgatagaatagggcaacctatgttaactggcaacgggaattttaagcagtatttcagtgttcctaaaagcactataaaccaccgcaccagcggtacaatctctgtttccaaacactttgaagaatgggaaaaagtcggcatgaaaatggacggtcccttatacgaagtagcgatgaaagttgaatcctattctggcaatgggaatagtaacggcaatgctaaaattacaaagaatattttgaccattggcggaacaaccacaactcaaagcagttcaagcggaggttcaacggttccagatgaatgtggcgaatataaaaagagtttctgtggtggcttgggatatggaagcgtatattccaatttaaccgcaataccctcaacgggcgactgcttatacatcggagattttgaagtaatccagccagctttgaattcaaccgttgccataaacggtgtggaaaatacctgcggaagcgagtggtcagattgcccttacaatgataaacccgattcaaaaaaagatggcggctattatgtttatgtgaaaacaggctcaattaacaattatgagaataacggttggcaaaacattgtagctaaagcaaaaccggcttgcacaccaccttctagcagttccggtgctgcaccaggttcttcttcttcagacgaagaagacccagagccaattttgaaaaatcgcattcctataactcatttttcccttcaaacgcttagcgataaagccttgcgcatagaagtaaatgctccaactattgtggacatttttgacctgagagggaataaggttaaaagtttgaatgtttacggttcgcaaagggttaaattatccctgccgagcggggtgtattttgccaaagtgcgcgggatgaaaagcgttagatttgtgttgaggtaa

SEQ ID NO: 174 - protein, 500 aa, Unknown
  Obtained from an environmental sample
  SIGNAL (1)...(22)
LKKLAAALSLAITFAVPTIVQAQGPTWTTSTIQKYNNYDYELWNENNQGTVSMKLTGDNGTAANAVGGTFESTWSGTKNVLFRSGRKFTGTSGQSVDGGGAGKTASAYGNISINFAATWSSGDDVKMLGVYGWAFYALPSVPDKQENGTSTNFSNQIEYYIIQDRGSYNSATGGTNSKKYGEATIDGIAYEFRVCDRIGQPMLTGNGNFKQYFSVPKSTINHRTSGTISVSKHFEEWEKVGMKMDGPLYEVAMKVESYSGNGNSNGNAKITKNILTIGGTTTTQSSSSGGSTVPDECGEYKKSFCGGLGYGSVYSNLTAIPSTGDCLYIGDFEVIQPALNSTVAINGVENTCGSEWSDCPYNDKPDSKKDGGYYVYVKTGSINNYENNGWQNIVAKAKPACTPPSSSSGAAPGSSSSDEEDPEPILKNRIPITHFSLQTLSDKALRIEVNAPTIVDIFDLRGNKVKSLNVYGSQRVKLSLPSGVYFAKVRGMKSVRFVLR

SEQ ID NO: 175 - DNA, 1053 bp, Unknown
  Obtained from an environmental sample
atgaagtccattcgcagccgcagcctcgccaccgccgtcctggctggcgccctcggcgtcgcagccgcaggcgcgcaggcgcagacgctcaacaacaattccaccggcacgcacgacggctactactacacgttctggaaggactcgggcagcgcctcgatgaccctccatccgggcggacgctacagctcccagtggaccagcaacaccaacaactgggtcggcgggaaaggctggaatcccggtggcccgcgcgtggtcaactactcgggctactacggggtcaacaacagccagaactcctacctggcgctgtacggctggacccgcaatccgctggtcgagtactacgtgatcgagagctacggctcctacaacccggccagttgcgccggcggggtggactacggcagcttccagagcgatggcgccacctacaacgtacgtcgctgcctgcgccagaacgcgccgtcgatcgaaggcaacaacagcaccttctaccagtacttcagcgtgcgcaatcccaagaagggattcggcaacatctccggcacgatcaccgtcgccaaccacttcaactactgggccagccgcggcctcaacctcggcaaccacgactacatggtgttcgccaccgagggctaccagagccagggcagcagcgacatcaccgtgagttcgggtaccggcggcggcggtggcggcggcaacacgggcagcaagaccatcgtggtgcgcgcgcgcggcaccgccggcggagagaacatctcgctcaaggtcaacaacgccaccatcgccagctggacgctcaccaccagcatggccaactacacggccaccacctcggcatcgggcggctcgctggtggagttcaccaacgacggcggcaaccgcgacgtgcaggtggactacctcagcgtcaatggcgccgtccgccaggccgaggaccagacctacaacaccggcgtgtaccagaacggccagtgcggcggcggcaacggccgcagcgaatggctgcactgcaacggtgccatcggcttcggaaatctctga

SEQ ID NO: 176 - protein, 350 aa, Unknown
  Obtained from an environmental sample
  SIGNAL (1)...(27)
MKSIRSRSLATAVLAGALGVAAAGAQAQTLNNNSTGTHDGYYYTFWKDSGSASMTLHPGGRYSSQWTSNTNNWVGGKGWNPGGPRVVNYSGYYGVNNSQNSYLALYGWTRNPLVEYYVIESYGSYNPASCAGGVDYGSFQSDGATYNVRRCLRQNAPSIEGNNSTFYQYFSVRNPKKGFGNISGTITVANHFNYWASRGLNLGNHDYMVFATEGYQSQGSSDITVSSGTGGGGGGGNTGSKTIVVRARGTAGGENISLKVNNATIASWTLTTSMANYTATTSASGGSLVEFTNDGGNRDVQVDYLSVNGAVRQAEDQTYNTGVYQNGQCGGGNGRSEWLHCNGAIGFGNL

SEQ ID NO: 177 - DNA, 1299 bp, Unknown
  Obtained from an environmental sample
atgaaattgttgaaaacgcacaggcgtgcgattgctgccgcagcactagcggtggcgactgttccaatcgctcatgcgcaaacgcttagctcaaatgccactggaacccagaatggttactactattcgttttggaaggattccggtaacgccaccatgacactcggtgccggtggaaactattcttcatcctggaacagcagcactaacaactgggttggcggtaaaggctggatgccgggtactcggcgcacagtcacctattcgggcagttatagcgcgagtggaaccagctacctcgcactttacggctggactcgaaacccgctgatcgaatattacattgtcgaaaactgggtcaattacaatcctgcgtccggcgcaacgaattatgggactgtcaatattgacggcagcacctaccagctgggccgcagccaacgggttaatcagccatctattgaaggcacggccacgttctaccaatactggagtgtgcgccaaaacaagcgcaccagcggaacgattaatattggagcgcatttcgatgcatgggctgctgtgggcttgaacctggggactcacgattatcagattatggcgaccgagggctaccagagcagcggccagtccaatatcacggtgagcgaaggcagtagcggcagcacgacttcgagcacatccagctccagctcaagtacgagttccagtagttcttccagcagttcttccggcggcggcacaggaagttgtgccggagtgaatgtgtaccccaattggaccgcacgcgactggtctggcggcgcatacaatcacgccaatgccggtgaccaaatggtctatcaaaacaatttgtaccgggcaaactggtacaccaactccacgcctggaagcgatgcctcctggaccagtctcgggtcctgtagcggcggcggtagcaccagttcaacaacgagctcctccagttcctcttccacctcggcgtcgagcagctccaactcatccagcagcagttcaagcagctccagcagcggtggctgtcgggaaatgtgtaactggtacggacagggtatgtatcctctgtgtcagaacaccagcggttggggatgggaaaataaccagaactgtatcggtcgccaaacctgtcaaagtcagaacggcggctccgggggtgtggtgaacagctgtggtaccagcagctcttcgtccagtagcacctcctcatcgagcagttcaagttcgtcgagtggcaccacgtcatcgtcctccggaattcctgcagcccgggggatccactag

SEQ ID NO: 178 - protein, 432 aa, Unknown
  Obtained from an environmental sample
  SIGNAL (1)...(26)
MKLLKTHRRAIAAAALAVATVPIAHAQTLSSNATGTQNGYYYSFWKDSGNATMTLGAGGNYSSSWNSSTNNWVGGKGWMPGTRRTVTYSGSYSASGTSYLALYGWTRNPLIEYYIVENWVNYNPASGATNYGTVNIDGSTYQLGRSQRVNQPSIEGTATFYQYWSVRQNKRTSGTINIGAHFDAWAAVGLNLGTHDYQIMATEGYQSSGQSNITVSEGSSGSTTSSTSSSSSSTSSSSSSSSSSGGGTGSCAGVNVYPNWTARDWSGGAYNHANAGDQMVYQNNLYRANWYTNSTPGSDASWTSLGSCSGGGSTSSTTSSSSSSSTSASSSSNSSSSSSSSSSSGGCREMCNWYGQGMYPLCQNTSGWGWENNQNCIGRQTCQSQNGGSGGVVNSCGTSSSSSSSTSSSSSSSSSSGTTSSSSGIPAARGIH

SEQ ID NO: 179 - DNA, 852 bp, Unknown
  Obtained from an environmental sample
atgaagaattggccgggaacgggtattatattattattggcgggcggccttttggcggcttgtttgacgggcaaacggcaagaggggcaaaaagtggatccggatactcaaaacgagaaattgacaggcgggaccgtgtttacagctaacagcagggggaacaggcccctggaaggttcgccttatggttacgaaatgtggacgcagggcgggaataataacaagcttgtttggttcgggccggatcaggggggaggggcggctttcagggcagaatggaacgagccggatgattttttgggacgactgggtttctggtggggaaacggcgggcaatttaaagaatataaaaatatgtacgcggatttcaattacacaaggtcggggcgcggcaccggcggcagttattcttatataggcatttacggctgggcgagaaacccgaacgccgcgaacgaggaagacaggttaatagaatactatattgtggacgactggttcgggaatcaatggcagtccgacgacacccccattaccacaagaacaacaggaggctccgtattgggtaccattatagcggacggcgcgttttacaacgtcgtcaggaatgtgagaacccaaaagccttcgatagacggcatcaaaacattcgcccaatacttcagcatacgccaaacaccgcgccaaagcgggacaatctccatcaccgaacatttcaaacaatgggaaagcatgggcctgaagctcggaaatatgtacgaggcaaaattcctggtagaagccggcggcggcaccggctggctggagtttacgtatcttaaactgacgcaggaagaaaaaaaaagaaattag

SEQ ID NO: 180 - protein, 283 aa, Unknown
  Obtained from an environmental sample
  SIGNAL (1)...(19)
MKNWPGTGIILLLAGGLLAACLTGKRQEGQKVDPDTQNEKLTGGTVFTANSRGNRPLEGSPYGYEMWTQGGNNNKLVWFGPDQGGGAAFRAEWNEPDDFLGRLGFWWGNGGQFKEYKNMYADFNYTRSGRGTGGSYSYIGIYGWARNPNAANEEDRLIEYYIVDDWFGNQWQSDDTPITTRTTGGSVLGTIIADGAFYNVVRNVRTQKPSIDGIKTFAQYFSIRQTPRQSGTISITEHFKQWESMGLKLGNMYEAKFLVEAGGGTGWLEFTYLKLTQEEKKRN

SEQ ID NO: 181 - DNA, 1077 bp, Unknown
  Obtained from an environmental sample
atgaacttcagtctcaggaaggctgcagcggcgctggcttgcgtcgcgggcctgtatgcatcatcggcgggcgctcagacctgcctgaccaacaaccagaccggcaacaacggcgggtactactactcgttctggaaggacagcggcaacgtcaccttctgcctgcagtccggcgggcgatacacgtcccagtggagcaacgtcaacaactgggtgggcggcaagggctggaacccgggtgggcgacgcaccgtcacctattccggcacctacaaccccaatggcaattcgtacctgaccctgtacggctggaccacgaatccactggtcgagtactacatcgtcgacagctggggttcctggcgcccaccgggctcgggatacatgggcacggtcaccagcgatggcggcacctacgacatctatcgcacgcagcgtgtgaaccagccttccatcatcggcaccgcgacgttctaccaatactggagcgtgcggcaatcgaagcgcgtgggtggcaccatcacctcgggcaatcacttcgatgcctgggcctcgctgggcatgaacctcggcacgcacaactacatggtgatggccaccgagggctaccagagcagcggcagctcggacatcacggtgggcagcggcagttcgtcgtcgagcagcagctcgtccagcagtagcagctcgtcgtccagtagcagcagcagttcttcgtccagcagcagcggtggcggcggcaccaagagcttcaccgtgcgcgcacgcggcacggcgggtggcgagtccatcaccttgcgggtgaacaaccagaacgtgcagacctggacgctgggcaccagcatgcagaactacacggcgtccacctcgctgagcggcggcatcacggtggccttcaccaacgacggcggcaaccgcgacgtccaggtggattacatcatcgtgaatggccagacgcgccagtccgaggcgcagacctacaacaccggcctgtatgccaatggccgctgcggtggtggctctaacagcgagtggatgcactgcaacggcgccatcggctacggcaacacgccctag

SEQ ID NO: 182 - protein, 358 aa, Unknown
  Obtained from an environmental sample
  SIGNAL (1)...(25)
MNFSLRKAAAALACVAGLYASSAGAQTCLTNNQTGNNGGYYYSFWKDSGNVTFCLQSGGRYTSQWSNVNNWVGGKGWNPGGRRTVTYSGTYNPNGNSYLTLYGWTTNPLVEYYIVDSWGSWRPPGSGYMGTVTSDGGTYDIYRTQRVNQPSIIGTATFYQYWSVRQSKRVGGTITSGNHFDAWASLGMNLGTHNYMVMATEGYQSSGSSDITVGSGSSSSSSSSSSSSSSSSSSSSSSSSSSSGGGGTKSFTVRARGTAGGESITLRVNNQNVQTWTLGTSMQNYTASTSLSGGITVAFTNDGGNRDVQVDYIIVNGQTRQSEAQTYNTGLYANGRCGGGSNSEWMHCNGAIGYGNTP

SEQ ID NO: 183 - DNA, 1083 bp, Unknown
  Obtained from an environmental sample
atgatcgaaggtctcaggagacctgccttcagtggcaggagcatcgtcaaggcattgctctgcgtcgcggccctgtatgcatcggcggcgcaggcgcagacctgtctcagttcgagccagaccggcaccaacaacggcttctactattcgttctggaaggacagcccgggcagcgtgcagttctgcatgtattccggcggccgctacacatccaactggagcggcatcaacaactgggtcggcggcaaggggtggcagaccggcgcctcgcgcgtggtcagctactcgggcacgttcaattcaccgggcaacggctacctggcgctgtacggctggaccaccaatccactggtcgagtactacatcgtcgacaactggggcacctatcgcccgccgggcggcacgggattccagggcacggtgaccagtgacggcggtacctacgacatctaccggaccgagcgcaccaacgcgccctgcatcaccggcaacaactgcaacttctcgcagttctggagcgtgcggcagtcgaagcgcaccggcggcaccatcaccaccggcaatcacttcagcgcctgggcgtcgcacggcatgaacatgggccagcacaactaccagatcatggccaccgagggttaccagagcaacggcagctcggacatcacggtctcggaaggcagcagttcgtcgagcagcagcagttcgtcctcttcgtcgagcagcagctcgtcgagcggcggcggcggcagcaagagcttcacggtgcgcgcccgcggcaccgcgggtggcgagcagatccggctgcgcgtgaacaatacgaccgtgcagacctggacgctgaacaccacgatgacgaactacaccgcttcgaccacgctgagcggcggcatcacggtggagtacttcaacgacagcaccaatcacgacgtgcaggtggactacatcatcgtgaacggcgcgacgcgccagtccgaagcgcagagctacaacaccggcctgtatgccaacggccgttgcggtggcggttccaacagcgaatggatgcattgcaatggcgccatcggctacggcaacactccataa

SEQ ID NO: 184 - protein, 360 aa, Unknown
  Obtained from an environmental sample
  SIGNAL (1)...(32)
MIEGLRRPAFSGRSIVKALLCVAALYASAAQAQTCLSSSQTGTNNGFYYSFWKDSPGSVQFCMYSGGRYTSNWSGINNWVGGKGWQTGASRVVSYSGTFNSPGNGYLALYGWTTNPLVEYYIVDNWGTYRPPGGTGFQGTVTSDGGTYDIYRTERTNAPCITGNNCNFSQFWSVRQSKRTGGTITTGNHFSAWASHGMNMGQHNYQIMATEGYQSNGSSDITVSEGSSSSSSSSSSSSSSSSSSSGGGGSKSFTVRARGTAGGEQIRLRVNNTTVQTWTLNTTMTNYTASTTLSGGITVEYFNDSTNHDVQVDYIIVNGATRQSEAQSYNTGLYANGRCGGGSNSEWMHCNGAIGYGNTP

SEQ ID NO: 185 - DNA, 684 bp, Unknown
  Obtained from an environmental sample
atgaatttgaaaagattgaggctgttgtttgtgatgtgtattggatttgtgctgacactgacggctgtgccagctcatgcggaaacgatttatgataataggatagggacacacagcggatacgattttgaattatggaaggattacggaaatacctcgatgacactcaataacggcggggcatttagtgcaagctggaacaatattggaaatgccttatttcgaaaaggaaagaagtttgattccactaaaactcatcatcaacttggcaacatctccatcaactacaacgcagcctttaacccgggcgggaattcctatttatgtgtctatggctggacacaatctccattagctgaatactacattgttgagtcatggggcacatatcgtccaacaggaacgtataaaggatcattttatgccgatggaggcacatatgacatatatgaaacgctccgtgtcaatcagccttctatcattggagacgctaccttcaaacaatattggagtgtacgtcaaacaaaacgcacaagcggaactgtttccgtcagtgagcattttaaaaaatgggaaagcttaggcatgccaatgggaaaaatgtatgaaacagcattaactgtagaaggctaccgaagcaacggaagtgcgaatgtcatgacgaatcagctgatgattcgataa

SEQ ID NO: 186 - protein, 227 aa, Unknown
  Obtained from an environmental sample
  SIGNAL (1)...(27)
MNLKRLRLLFVMCIGFVLTLTAVPAHAETIYDNRIGTHSGYDFELWKDYGNTSMTLNNGGAFSASWNNIGNALFRKGKKFDSTKTHHQLGNISINYNAAFNPGGNSYLCVYGWTQSPLAEYYIVESWGTYRPTGTYKGSFYADGGTYDIYETLRVNQPSIIGDATFKQYWSVRQTKRTSGTVSVSEHFKKWESLGMPMGKMYETALTVEGYRSNGSANVMTNQLMIR

SEQ ID NO: 187 - DNA, 642 bp, Unknown
  Obtained from an environmental sample
atgtttaagtttaaaaagaatttcttagttggattatcggcagctttaatgagtattagcttgttttcggcaaccgcctctgcagctagcacagactactggcaaaattggactgatgggggcggtatagtaaacgctgtcaatgggtctggcgggaattacagtgttaattggtctaataccggaaattttgttgttggtaaaggttggactacaggttcgccatttaggacgataaactataatgccggagtttgggcgccgaatggcaatggatatttaactttatatggttggacgagatcacctctcatagaatattatgtagtggattcatggggtacttatagacctactggaacgtataaaggtactgtaaaaagtgatgggggtacatatgacatatatacaactacacgttataacgcaccttccattgatggcgatcgcactacttttacgcagtactggagtgttcgccagtcgaagagaccaaccggaagcaacgctacaatcactttcagcaatcatgtgaacgcatggaagagccatggaatgaatctgggcagtaattgggcttaccaagtcatggcgacagaaggatatcaaagtagtggaagttctaacgtaacagtgtggtaa

SEQ ID NO: 188 - protein, 213 aa, Unknown
  Obtained from an environmental sample
  SIGNAL (1)...(28)
MFKFKKNFLVGLSAALMSISLFSATASAASTDYWQNWTDGGGIVNAVNGSGGNYSVNWSNTGNFVVGKGWTTGSPFRTINYNAGVWAPNGNGYLTLYGWTRSPLIEYYVVDSWGTYRPTGTYKGTVKSDGGTYDIYTTTRYNAPSIDGDRTTFTQYWSVRQSKRPTGSNATITFSNHVNAWKSHGMNLGSNWAYQVMATEGYQSSGSSNVTVW

SEQ ID NO: 189 - DNA, 570 bp, Unknown
  Obtained from an environmental sample
atggcccttatggcttcgacagactactggcaaaattggactgatggtggtgggacagtaaatgctaccaatggatctgatggcaattacagcgtttcatggtcaaattgcgggaattttgttgttggtaaaggctggactaccggatcagcaactagggtaataaactataatgccggagccttttcgccgtccggtaatggatatttggctctttatgggtggacgagaaattcactcatagaatattacgtcgttgatagctgggggacttatagacctactggaacttataaaggcactgtgactagtgatggagggacttatgacatatacacgactacacgaaccaacgcaccttccattgacggcaataatacaactttcacccagttctggagtgttaggcagtcgaagagaccgattggtaccaacaataccatcacctttagcaaccatgttaacgcctggaagagtaaaggaatgaatttggggagtagttggtcttatcaggtattagcaacagagggctatcaaagtagtgggtactctaacgtaacggtctggtaa

SEQ ID NO: 190 - protein, 189 aa, Unknown
  Obtained from an environmental sample
MALMASTDYWQNWTDGGGTVNATNGSDGNYSVSWSNCGNFVVGKGWTTGSATRVINYNAGAFSPSGNGYLALYGWTRNSLIEYYVVDSWGTYRPTGTYKGTVTSDGGTYDIYTTTRTNAPSIDGNNTTFTQFWSVRQSKRPIGTNNTITFSNHVNAWKSKGMNLGSSWSYQVLATEGYQSSGYSNVTVW

SEQ ID NO: 191 - DNA, 1053 bp, Unknown
  Obtained from an environmental sample
atgaagtccattcgcagccgcagcctcgccaccgccgtcctggctggcgccctcggcgtcgcagccgccggcgcgcaggcgcagacgctcaacaacaattccaccggcacgcacgacggcttctactacacgttctggaaggactcgggcagcgcctcgatgaccctccatccgggcggacgctacagctcccagtggaccagcaacaccaacaactgggtcggcgggaaaggctggaatcccggtggcccgcgcgtggtcaactactcgggctactacggggtcaacaacagccagaactcctacctggcgctgtacggctggacccgcaatccgctggtcgagtactacgtgatcgagagctacggctcctacaacccggccagttgcgccggcggggtggactacggcagcttccagagcgatggcgccacctacaacgtacgccgctgcctgcgccagaacgcgccgtcgatcgaaggcaacaacagcaccttctaccagtacttcagcgtgcgcaatcccaagaagggattcggcaacatctccggcacgatcaccgtcgccaaccacttcaactactgggccagccgcggcctcaacctcggcaaccacgactacatggtgttcgccaccgagggctaccagagccagggcagcagcgacatcaccgtgagttcgggtaccggcggcggcggtggcggcggcaacacgggcagcaagaccatcgtggtgcgcgcgcgcggcaccgccggcggagagaacatctcgctcaaggtcaacaacgccaccatcgccagctggacgctcaccaccagcatggccaactacacggccaccacctcggcatcgggcggctcgctggtggagttcaccaacgacggcggcaaccgcgacgtgcaggtggactacctcagcgtcaatggcgccgtccgccaggccgaggaccagacctacaacaccggcgtgtaccagaacggccagtgcggcggcggcaacggccgcagcgaatggctgcactgcaacggtgccatcggcttcggaaatctctga

SEQ ID NO: 192 - protein, 350 aa, Unknown
  Obtained from an environmental sample
  SIGNAL (1)...(27)
MKSIRSRSLATAVLAGALGVAAAGAQAQTLNNNSTGTHDGFYYTFWKDSGSASMTLHPGGRYSSQWTSNTNNWVGGKGWNPGGPRVVNYSGYYGVNNSQNSYLALYGWTRNPLVEYYVIESYGSYNPASCAGGVDYGSFQSDGATYNVRRCLRQNAPSIEGNNSTFYQYFSVRNPKKGFGNISGTITVANHFNYWASRGLNLGNHDYMVFATEGYQSQGSSDITVSSGTGGGGGGGNTGSKTIVVRARGTAGGENISLKVNNATIASWTLTTSMANYTATTSASGGSLVEFTNDGGNRDVQVDYLSVNGAVRQAEDQTYNTGVYQNGQCGGGNGRSEWLHCNGAIGFGNL

SEQ ID NO: 193 - DNA, 840 bp, Unknown
  Obtained from an environmental sample
atgacgaagtatcggttaggaataggtattttcattttgttggtttgttgcttttcggcggcatgtattgtgcctaaacaacaagaggaacaaaaagtggctcctacagaattgaccggcgcgataacattcacagccaacagcaacggaaacaagcccctgaacggctcgccctacggttacgaaatatggacacagggcgggaccaataacaaactgatctggttcgggccggatcagggcggcggcgcggctttcagagccgaatggaacaaccctaacgattttttaggccgcgtgggtttttactggggtaatggcggaaaatataccgagtacaaaaatatgtatgcggattttagctacactagatctggacgcaacaccgccggtaattattcatatatagggatttatggctgggctagaaatccaaatgccgcaaaagaagaagacaaattgatagagtattatattgtggaagattggtttggcaatcaatggcaagaggatagctcacccattaccactaatacaacaagtggaaccgtattgggaagttttactatagatggcgcggtttataatgtcgttagaaatgtcagagtccaacaaccttcgatagacggaaccaaaacattcacccaatacttcagcatacgacaaacgccccgacagagcgggacaatttccattaccgggcatttcaggcaatgggagagcatgggtttacagcttggcaatatgtacgaggcaaagtttcttgttgaagccggcggcggcacaggatggctggaattttcataccttaaattaacgatggaagacagcttaaggtaa

SEQ ID NO: 194 - protein, 279 aa, Unknown
  Obtained from an environmental sample
  SIGNAL (1)...(21)
MTKYRLGIGIFILLVCCFSAACIVPKQQEEQKVAPTELTGAITFTANSNGNKPLNGSPYGYEIWTQGGTNNKLIWFGPDQGGGAAFRAEWNNPNDFLGRVGFYWGNGGKYTEYKNMYADFSYTRSGRNTAGNYSYIGIYGWARNPNAAKEEDKLIEYYIVEDWFGNQWQEDSSPITTNTTSGTVLGSFTIDGAVYNVVRNVRVQQPSIDGTKTFTQYFSIRQTPRQSGTISITGHFRQWESMGLQLGNMYEAKFLVEAGGGTGWLEFSYLKLTMEDSLR

SEQ ID NO: 195 - DNA, 1044 bp, Unknown
  Obtained from an environmental sample
atgttcaatctgaagagagtggcggcgctcctgtgcgtcgcagggctgggggtgtctgcggcaaatgcgcagacctgtctcaattcgagtgggaccggcaccaacaacggcttctattattccttctggaaagacagtccgggttcagtgaatttctgcatgtactccggcggtcgctacacgtcgagctggagcggcatcaacaactgggtcggcggcaagggctggcaaaccggatcgcgccggaccatcaactactccggcagcttcaactcgccgggcaatggctacctcgcgctctacggatggaccaccaatccactcgtcgagtactacatcgtcgacaactggggcacgtatcgtccgcccggcggccagggctacatgggcacggtcacgagcgacggcgccacgtacgacgtctatcgaacgcaacgagtcgatgcgccgtcgatcattggtgatcaccagaccttctatcaatactggagcgtgcgtcagtcgaagaggaccggcggaaccatcaccaccggcaaccacttcgatggctgggcgagctacggcatgaacctgggaactcacaactaccagatcctggcgaccgagggttatcaaagcagcggcagctcggacctcaccgtgagcgaaggcagcagcagtagcagcagcggtggcgggagcagttcgagcagcagcggcggcggtggcaccaagagcttcacggtccgcgcgcgcggcacggccggtggagagtcgatcacgttgcgcgtgaataaccagaacgtgcagacctggacgctcggcacgagcatgacgaactacacggcgtcgacgtcgctgagcggcggcatcaccgtggcgttcacgaacgacggtggcaaccgcgatgttcaggtggactacatcatcgtgaacggccagacacgccagtcggaagcgcagagctacaacaccgggctctacgcgaatggacgttgcggcggtggctcgaacagcgagtggatgcactgcaacggcgcgattggctacggaaacacgccgtaa

SEQ ID NO: 196 - protein, 347 aa, Unknown
  Obtained from an environmental sample
  SIGNAL (1)...(23)
MFNLKRVAALLCVAGLGVSAANAQTCLNSSGTGTNNGFYYSFWKDSPGSVNFCMYSGGRYTSSWSGINNWVGGKGWQTGSRRTINYSGSFNSPGNGYLALYGWTTNPLVEYYIVDNWGTYRPPGGQGYMGTVTSDGATYDVYRTQRVDAPSIIGDHQTFYQYWSVRQSKRTGGTITTGNHFDGWASYGMNLGTHNYQILATEGYQSSGSSDLTVSEGSSSSSSGGGSSSSSSGGGGTKSFTVRARGTAGGESITLRVNNQNVQTWTLGTSMTNYTASTSLSGGITVAFTNDGGNRDVQVDYIIVNGQTRQSEAQSYNTGLYANGRCGGGSNSEWMHCNGAIGYGNTP

SEQ ID NO: 197 - DNA, 636 bp, Unknown
  Obtained from an environmental sample
atgtttaagttcagtaagaaaatgatgacggttattcttgcagctaccatgagttttggtttatttgcaacaacctcaagtgcagcaaccgactattggcaaaattggaccgatggcggcggaacggttaatgctgtaaacggctccggcggtaattacagcgtgacatggcaaaataccggaaattttgtcgtcggcaaaggctggaataccggatcgcctaaccgaaccattaactacaatgccggcgtctgggcgccttccggcaatgggtatttgactctctacggatggacgagaaacgcactcattgaatattacgtcgtggatagctggggtacttatcggcctacaggaacatataaagggacggtgacaagtgatgggggcacatatgatatctatacgaccatgcggcacaacgcgccttccattgacggaactcaaacgtttgcccagtactggagtgttcgacaatcgaaaagagcgaccggggtcaactcctccattacgttcagcaaccacgtgaacgcatgggctagcaagggaatgaatctgggaagcagctggtcatatcaggtgttagctacagagggttatcaaagtagcggaagctctaacgtaacagtgtggtaa

SEQ ID NO: 198 - protein, 211 aa, Unknown
  Obtained from an environmental sample
  SIGNAL (1)...(28)
MFKFSKKMMTVILAATMSFGLFATTSSAATDYWQNWTDGGGTVNAVNGSGGNYSVTWQNTGNFVVGKGWNTGSPNRTINYNAGVWAPSGNGYLTLYGWTRNALIEYYVVDSWGTYRPTGTYKGTVTSDGGTYDIYTTMRHNAPSIDGTQTFAQYWSVRQSKRATGVNSSITFSNHVNAWASKGMNLGSSWSYQVLATEGYQSSGSSNVTVW

SEQ ID NO: 199 - DNA, 1074 bp, Unknown
  Obtained from an environmental sample
atgattttcggtctaaagtcgatcacgggcaggcgcgccgtcgcggcgctggcctgccttgccggcctctacatggcgccggcgaatgcgcaaacctgcatcacgtcgagccagacgggcaccaacaacggcaactacttttcgttctggaaagacagcccgggcacggtgaacttctgcatgtactccggcggccgctacacgtccaactggagcggcatcaacaactgggtgggcggcaagggctggcagacgggctcgtcccgcaccgtctcctactccggcagcttcaattcgccgggtaacggctacctgacgctctacggctggaccaccaatccgctcatcgagtactacatcgtcgacaactggggcagctatcgtccgccgggtggccagggcttcatgggcacggtgaacaccgacggcggcacgtacgacatctatcgcacgcaacgggtcaaccagccgtcgatcatcggcaccgcgacgttctaccagtactggagcgtgcggcagtcgaagcgcaccggcggcaccatcaccacggccaaccacttcaatgcctgggccagcctcggcatgaacctgggacagcacaactaccaggtgatggccaccgagggctaccagagcagcggcagctccgacatcacggtgtgggaaggcacgagcagcggcggaagcagcaatggcggcagcagcaacggcggcagcagcaatggtggcagcggcggcacgaagagcttcacggtgcgcgcgcgcggcactgcgggcggcgagtccatcacgctgcgggtcaacaaccagaacgtgcagacctggacgctgggtaccagcatgcagaactacacggcctcgacctcgctgagcggcggcatcacggtggcgttcaccaacgacggcggcagccgcgacgtgcaggtggactacatcatcgtgaatggccagacccgccagtccgaacagcagagctacaacactggcctctacgccaatggaagctgtggtggcggttcgaacagcgagtggatgcattgcaacggcgccatcggctacggcaatacgccctga

SEQ ID NO: 200 - protein, 354 aa, Unknown
  Obtained from an environmental sample
  SIGNAL (1)...(30)
MIFGLKSITGRRAVAALACLAGLYMAPANAQTCITSSQTGTNNGNYFSFWKDSPGTVNFCMYSGGRYTSNWSGINNWVGGKGWQTGSSRTVSYSGSFNSPGNGYLTLYGWTTNPLIEYYIVDNWGSYRPPGGQGFMGTVNTDGGTYDIYRTQRVNQPSIIGTATFYQYWSVRQSKRTGGTITTANHFNAWASLGMNLGQHNYQVMATEGYQSSGSSDITVWEGTSSGGSSNGGSSNGGSSNGGSGGTKSFTVRARGTAGGESITLRVNNQNVQTWTLGTSMQNYTASTSLSGGITVAFTNDGGSRDVQVDYIIVNGQTRQSEQQSYNTGLYANGSCGGGSNSEWMHCNGAIGYG

SEQ ID NO: 201 - DNA, 1002 bp, Unknown
  Obtained from an environmental sample
atgaagatgaacagctccctcccctccctccgcgatgtattcgcgaatgatttccgcatcggggcggcggtcaatcctgtgacgatcgagatgcaaaaacagttgttgatcgatcatgtcaacagtattacggcagagaaccatatgaagtttgagcatcttcagccggaagaagggaaatttacctttcaggaagcggatcggattgtggattttgcttgttcgcaccgaatggcggttcgagggcacacacttgtatggcacaaccagactccggattgggtgtttcaagatggtcaaggccatttcgtcagtcgggatgtgttgcttgagcggatgaaatgtcacatttcaactgttgtacggcgatacaagggaaaaatatattgttgggatgtcatcaacgaagcggtagccgacgaaggagacgaattgttgaggccgtcgaagtggcgacaaatcatcggggacgattttatggaacaagcatttctctacgcttatgaagctgacccagatgcactgcttttttacaatgactataatgaatgttttccggaaaagagagaaaaaatttttgcacttgtcaaatcgctgcgtgataaaggcattccgattcatggcatcggcatgcaggcgcactggagcctgacccgcccgtcgcttgatgaaattcgtgcggcgattgaacggtatgcgtcccttggtgttgttcttcatattacggaactcgatgtatccatgtttgaatttcacgatcgtcgaaccgatttggctgtcccgacgaacgaaatgatcgaacagcaagcagaacggtatgggcaaatttttgctttgtttaaggagtatcgcgatgttattcaaagtgtcacattttggggaattgctgatgaccatacatggctcgataactttccagtgcacgggagaaaaaactggccgcttttgttcgatgaacagcataaaccgaaaccagctttttggcgggcagtgagtgtctga

SEQ ID NO: 202 - protein, 333 aa, Unknown
  Obtained from an environmental sample
MKMNSSLPSLRDVFANDFRIGAAVNPVTIEMQKQLLIDHVNSITAENHMKFEHLQPEEGKFTFQEADRIVDFACSHRMAVRGHTLVWHNQTPDWVFQDGQGHFVSRDVLLERMKCHISTVVRRYKGKIYCWDVINEAVADEGDELLRPSKWRQIIGDDFMEQAFLYAYEADPDALLFYNDYNECFPEKREKIFALVKSLRDKGIPIHGIGMQAHWSLTRPSLDEIRAAIERYASLGVVLHITELDVSMFEFHDRRTDLAVPTNEMIEQQAERYGQIFALFKEYRDVIQSVTFWGIADDHTWLDNFPVHGRKNWPLLFDEQHKPKPAFWRAVSV

SEQ ID NO: 203 - DNA, 687 bp, Unknown
  Obtained from an environmental sample
atgaaatctgcacgcgcacttttggtggcgctatcacgcatacttccgatcgcacttgtgctgttgctcgcccccgtccccgcgcaagcccaacaggtctgcaacaacggaacgggcacgcataacggcttcttctggacgttttggaaggacggcggcacggcctgcatgacgctcggctcgggcggcaattatagcacgacgttcaatctgtccggcggccgcaaccttgttgcgggcaagggctggcagactggctccaccaaccgagtcgtcggttacaatgcgggcgtctggaacccaggcaccaattcttatctgacgctctatggctggtcgacgaatccgctcgtcgaatattatgtcgtggaccattggggcagccaattcaccccgccaggcaacggcgcgcagagcatggggaccgtgaccaccgacggcggcacctacaacatctaccgcacccaacgcgtcaacgcgccttcgatcatcggcaacgccacgttctaccaatattggagcgtgcgcacttcgcgccgcgggcaaggcacgaacaacacgatcaccttcgccaatcacgtcaacgcttggcgcagccgcggcatgaaccttgggaccatgaattatcaagtcatggccacggaaggtttcggctcgaacggaagctccaacctcacagtatggtag

SEQ ID NO: 204 - protein, 228 aa, Unknown
  Obtained from an environmental sample
  SIGNAL (1)...(30)
MKSARALLVALSRILPIALVLLLAPVPAQAQQVCNNGTGTHNGFFWTFWKDGGTACMTLGSGGNYSTTFNLSGGRNLVAGKGWQTGSTNRVVGYNAGVWNPGTNSYLTLYGWSTNPLVEYYVVDHWGSQFTPPGNGAQSMGTVTTDGGTYNIYRTQRVNAPSIIGNATFYQYWSVRTSRRGQGTNNTITFANHVNAWRSRGMNLGTMNYQVMATEGFGSNGSSNLTVW

SEQ ID NO: 205 - DNA, 1068 bp, Unknown
  Obtained from an environmental sample
atgcaaattttcaaatcaccactgtcatgggccggatcactattactgatcctgtccaccgccctgttttcaacagcggccactgcccaggaatactgctccaaccagaccggtacacacagcggtttttactttacccattggtctgacggcggcggtactgcctgcattactctgggagacgacggaaattacagttacacctggtccaacacaggcaattttgtcggtggcaagggctggagtaccggcacctccaatcgggtgatcggttacaacgccggagactactcgccctccggcaactcctacctggcgctgtatggctggagcaccaatccactgattgagtactacgtggtggatagctggggtagctggcgtccgccgggtggcacctcggtaggtacagtcaccagcgatggcgggacttacgacctgtaccgcaccgagcgcgtgcagcagccctccatcgaaggcacggccaccttctatcaatattggagcgtgcgcacctcacagcgtccccaggggcagaacaacaccatcacctttcagaaccacgtggatgcctgggccaatcagggctggaacctcggcacccacaactatcaggtaatggcgaccgaaggctacgaaagcagcggcagctccaacgtcacggtttgggattccggcaccagtagcggtaacggtggcaacgctggcggcggtggtggcgaggcaggtaacggctccaactcactggtcgtgcgtgcggtgggcacttcgggcaacgaacagttgcgcgtcaacgtcagcggcaacacggttgaaaccctgaacctgtctaccaactggcaggactacaccatcaacaccaacgcttccggcgatgtgaatgtggagttgatcaacgatcagggcgagggctacgaagcccgggtggaatacgtcatcgtcaacggcgatacccgctacggcgctgatcagagctacaacaccagcgcctgggacggcgagtgcggcggcggttcctttaccatgtggatgcactgcgaaggcatcctcggttttggcgatatgtaa

SEQ ID NO: 206 - protein, 355 aa, Unknown
  Obtained from an environmental sample
  SIGNAL (1)...(29)
MQIFKSPLSWAGSLLLILSTALFSTAATAQEYCSNQTGTHSGFYFTHWSDGGGTACITLGDDGNYSYTWSNTGNFVGGKGWSTGTSNRVIGYNAGDYSPSGNSYLALYGWSTNPLIEYYVVDSWGSWRPPGGTSVGTVTSDGGTYDLYRTERVQQPSIEGTATFYQYWSVRTSQRPQGQNNTITFQNHVDAWANQGWNLGTHNYQVMATEGYESSGSSNVTVWDSGTSSGNGGNAGGGGGEAGNGSNSLVVRAVGTSGNEQLRVNVSGNTVETLNLSTNWQDYTINTNASGDVNVELINDQGEGYEARVEYVIVNGDTRYGADQSYNTSAWDGECGGGSFTMWMHCEGILGFGDM

SEQ ID NO: 207 - DNA, 633 bp, Unknown
  Obtained from an environmental sample
atgaaattaaaaaagaagatgctcactttactcctgacggcttcgatgagtttcggtttatttggggcaacctcgagtgcagcaacggattattggcaatattggacggatggcggcggaacggtgaatgcggttaacgggtccgggggcaattacagcgtaacttggcaaaatagcgggaacttcgtggtcggcaaaggctggagcgtagggtcgccaaatcggacgatcaattacaatgccggcatctgggaaccttcggggaacgggtacttgaccctttacggatggactagaaactcgctgatcgagtattacgttgtcgacagttgggggacgtaccggccaacaggtactcacaaaggaacggtgaacagcgacggaggcacctacgatatttatacgaccatgcgctataatgcgccttccattgatggcacgcagacgttccaacagttctggagcgtgcggcaatcgaaacgaccaaccggcagcaacgtctccatcaccttcagcaatcacgtgaatgcctggagaagcaagggcatgaacctgggcagcagctggtcgtaccaggtcttggcgacggaaggctatcagagcagcggaagatccaacgtcacggtgtggtaa

SEQ ID NO: 208 - protein, 210 aa, Unknown
  Obtained from an environmental sample
  SIGNAL (1)...(27)
MKLKKKMLTLLLTASMSFGLFGATSSAATDYWQYWTDGGGTVNAVNGSGGNYSVTWQNSGNFVVGKGWSVGSPNRTINYNAGIWEPSGNGYLTLYGWTRNSLIEYYVVDSWGTYRPTGTHKGTVNSDGGTYDIYTTMRYNAPSIDGTQTFQQFWSVRQSKRPTGSNVSITFSNHVNAWRSKGMNLGSSWSYQVLATEGYQSSGRSNVTVW

SEQ ID NO: 209 - DNA, 1194 bp, Unknown
  Obtained from an environmental sample
atgaaaacatttagtgtgaccaagtctagcgttgttttcgcaatggctttgggtatggcttcgacagcttttgctcaggatttctgcagcaatgcgcaacattccggccaaaaggtaacgattacttcgaaccaaactggtaaaatcggcgatatcggttacgaactctgggacgaaaacggtcatggtggtagtgctaccttctatagcgatggttccatggactgcaatatcactggtgctaaggactatctctgccgtgcgggcctttccctcggcagtaacaagacctacaaggaacttggtggtgatatgattgccgagttcaagcttgtgaagagcggtgcccagaatgtgggttactcttatatcggtatctatggctggatggaaggtgtttctggaacgcctagccagttggtcgaatactacgtgattgataacaccctcgccaatgacatgccgggtagctggattggtaacgaaagaaagggtaccattacggttgacggcggtacctatactgtttatcgcaatacccgtacaggtccggctattaagaacagcggtaacgtcacgttctatcagtatttcagcgttcgtacctctccgcgcgattgcggtaccatcaatatttccgaacacatgagacagtgggaaaagatgggcatgaccatgggtaagctctacgaagccaaggtgcttggcgaagcgggtaacgtgaatggcgaagtccgcggtggtcacatggacttcccgcatgctaaggtttatgtgaaaaacggctctgatccggcttcttcctcttctgtgaagtccagctcttctacagtaacgccaaaatccagctcctcgaagggtaacggcaacgtttctggtaaaattgacgcctgcaaggacgctatgggccatgaaggcaaagaaacgagaactcagggtcagaacaactctagcgtgacgggtaacgtcggcagctctccgtaccactatgaaatttggtatcagggtggtaacaactccatgacgttctacgacaacggtacttataaggcaagctggaatggtaccaacgacttccttgctcgtgtcggtttcaagtatgatgaaaagcacacttacgaagaacttggccctatcgatgcctactacaagtggagcaagcagggtagtgctggtggctacaactacatcggt

SEQ ID NO: 210 - protein, 398 aa, Unknown
  Obtained from an environmental sample
  SIGNAL (1)...(25)
MKTFSVTKSSVVFAMALGMASTAFAQDFCSNAQHSGQKVTITSNQTGKIGDIGYELWDENGHGGSATFYSDGSMDCNITGAKDYLCRAGLSLGSNKTYKELGGDMIAEFKLVKSGAQNVGYSYIGIYGWMEGVSGTPSQLVEYYVIDNTLANDMPGSWIGNERKGTITVDGGTYTVYRNTRTGPAIKNSGNVTFYQYFSVRTSPRDCGTINISEHMRQWEKMGMTMGKLYEAKVLGEAGNVNGEVRGGHMDFPHAKVYVKNGSDPASSSSVKSSSSTVTPKSSSSKGNGNVSGKIDACKDAMGHEGKETRTQGQNNSSVTGNVGSSPYHYEIWYQGGNNSMTFYDNGTYKASWNGTNDFLARVGFKYDEKHTYEELGPIDAYYKWSKQGSAGGYNYIG

SEQ ID NO: 211 - DNA, 1086 bp, Unknown
  Obtained from an environmental sample
atgataagttctaaagcatcacagtcatggggctggtcactattggtggccctgtccgccgttctgctttcggcgacagcttccgcccagcaacactgctccaaccaaaccggtacgcacaacggtttttactttacccattggtcagacggtggcggtaccgcctgcatgactctgggggacgacggcaactacagctatacctggtccaacactggcaattttgtcggtggtaagggctggagcacaggtacatccaaccgggtgattggttacaacgccggagactactcgccctccggcaactcctacctggcactgtatggctggagcaccaatccgctgattgaatattacgtggtcgacagttggggcagctggcgtccgccgggtggcacctctgtgggcacggtaaccagcgacggtggcacttacgacctgtaccgaacccagcgtgtgcagcagccctccattgagggtacggccaccttctatcaatactggagcgtgcgcacctcacagcggcctcaggggcaaaacaacaccatcacctttcagaaccacgtgaatgcctgggccaatcagggctggaatctgggcacccacaactatcaggtgatggcgaccgaaggctacgaaagcagcggcagctccaacgtcaccgtttgggattccggcaccagtagcggtggcggtggcggtggcaacgcgggcggcggcggagcccccggtggtggtgaggctggaggcggctccaactcactggttgtgcgtgcggtgggcacttcgggcaatgaacagttgcgcgtcaacgtcagtggcaacacggtggaaaccctgaacctgtctaccaactggcaggactacaccatcaacaccaacgcctccggcgatgtcaatgtggaattgatcaacgaccagggcgaaggctacgaggcccgcgtcgagtacgtcatcatcaacggcgatacccgctacggcgccgaccagagctacaacaccagcgcctgggacggcgagtgcggtagcggttcctttaccatgtggatgcactgcgaaggcatcctcggttttggcgatatgtaa

SEQ ID NO: 212 - protein, 361 aa, Unknown
  Obtained from an environmental sample
  SIGNAL (1)...(29)
MISSKASQSWGWSLLVALSAVLLSATASAQQHCSNQTGTHNGFYFTHWSDGGGTACMTLGDDGNYSYTWSNTGNFVGGKGWSTGTSNRVIGYNAGDYSPSGNSYLALYGWSTNPLIEYYVVDSWGSWRPPGGTSVGTVTSDGGTYDLYRTQRVQQPSIEGTATFYQYWSVRTSQRPQGQNNTITFQNHVNAWANQGWNLGTHNYQVMATEGYESSGSSNVTVWDSGTSSGGGGGGNAGGGGAPGGGEAGGGSNSLVVRAVGTSGNEQLRVNVSGNTVETLNLSTNWQDYTINTNASGDVNVELINDQGEGYEARVEYVIINGDTRYGADQSYNTSAWDGECGSGSFTMWMHCEGILGFGDM

SEQ ID NO: 213 - DNA, 912 bp, Unknown
  Obtained from an environmental sample
gtgaacgcacaacaaacccttacgtctaactccaccggtactcatggtggtcactactattctttctggaaggactccggcaatgcgtccttcactctctacgatggcggacgttacggctcgcaatggaatagcggcaccaacaattgggtgggcggtaaaggctggaacccgggcggcgcaaaagtcgttaactacgaaggttattacggcgttaacaattcccagaattcttacctggcactctacgggtggacccgcaatccgctgatcgagtactacataatcgaaagttacggttcgtacaacccatcgagctgtagtggcggtactaactacggtagcttccaaagcgatggtgcgacctataacgtccgccgttgccagcgcgtacagcagccatcgattgatggaacgcaaacgttctatcagtatttcagcgttcgctcacccaaaaagggcttcggccaaatcagcggcactatcaatgtaggcaaccactttaattattgggccagcaaagggctgaatttgggtagccacgattacatggttctggcgactgaaggctatcagagcagcggcaattcagatatttccgtgtccgaaggcagcagcggcggctcttcctcaggcggttcgacctccagcggaagctcctccggtagtacgaccagttcttcaggaggcggtggcggcggcatcacagtacgtgctcgcggcactaatggtgatgagcgtatcagcctgcgtgtcggcggttctgcggtagccagttggacactcagtaccagcgcacaaagctatagctacacaggcggcgcctctggcgatatccaggtggaattcgatatcaagcttatcgataccgtcgacctcgagggggggcccggtacccaattcgccctatag

SEQ ID NO: 214 - protein, 303 aa, Unknown
  Obtained from an environmental sample
VNAQQTLTSNSTGTHGGHYYSFWKDSGNASFTLYDGGRYGSQWNSGTNNWVGGKGWNPGGAKVVNYEGYYGVNNSQNSYLALYGWTRNPLIEYYIIESYGSYNPSSCSGGTNYGSFQSDGATYNVRRCQRVQQPSIDGTQTFYQYFSVRSPKKGFGQISGTINVGNHFNYWASKGLNLGSHDYMVLATEGYQSSGNSDISVSEGSSGGSSSGGSTSSGSSSGSTTSSSGGGGGGITVRARGTNGDERISLRVGGSAVASWTLSTSAQSYSYTGGASGDIQVEFDIKLIDTVDLEGGPGTQFAL

SEQ ID NO: 215 - DNA, 1065 bp, Unknown
  Obtained from an environmental sample
atgtttgcaagattcgagaaactggccgcggcgggtaaagccgtcgtggccctggcagggctcgcccttttgggcacggcgcctgccaatgcacagacctgtctcacgaacaattccaccggcaccaacaacggctactactactcgttctggaaggacagcggcaacgtgaccttctgcatgtacgggggcggccgctatacctcgcagtggagcaacatcaacaactgggtgggcggcaagggctggaatccgggcggtcgtcggaccgtcacctattcggggacgttcaacccgaacggcaattcctatctcacgctgtacggctggaccaccaatccactggtcgagtactacatcgtcgacagctggggcagctggcgtccgccgggttccggctacatgggttccgtcacgagcgacggcggcacctacgacatctatcgcacgcagcgcgtcaaccagccctcgatcatcggcaccgcgacgttctaccagtactggagcgtgcggcagcagaagcgcgtgggtggcaccatcaccaccggcaaccacttcgatgcctgggcttcgctgggcatgaacctcggccagcacaactacatggtcatggccaccgagggctaccagagcagcggcagctccgacatcacggtgggcggcaccagcagctcctcgtcgtcgagcgggggcagcagcagcagtagcagcagcagcgggggtggcggctcgaagagcttcaccgtgcgcgcgcggggttcgacgggcggtgagcagatcagtttgcgcgtgaacaaccagaccgtgcagaactggacgctgggcaccagcatgcagaactacaccgcgtccaccaacctgagcggcggcatcaccgtgcacttcaccaatgacagcggcaaccgcgacgtgcaggtggactacatccaggtgaacggccagacgcgtcaatccgagcagcagagctacaacaccgggctgtatgccaacggcagctgtggcggcggcggctacagcgagtggatgcattgcaatggcgcgatcggttacggcaacacgccgtag

SEQ ID NO: 216 - protein, 354 aa, Unknown
  Obtained from an environmental sample
  SIGNAL (1)...(31)
MFARFEKLAAAGKAVVALAGLALLGTAPANAQTCLTNNSTGTNNGYYYSFWKDSGNVTFCMYGGGRYTSQWSNINNWVGGKGWNPGGRRTVTYSGTFNPNGNSYLTLYGWTTNPLVEYYIVDSWGSWRPPGSGYMGSVTSDGGTYDIYRTQRVNQPSIIGTATFYQYWSVRQQKRVGGTITTGNHFDAWASLGMNLGQHNYMVMATEGYQSSGSSDITVGGTSSSSSSSGGSSSSSSSSGGGGSKSFTVRARGSTGGEQISLRVNNQTVQNWTLGTSMQNYTASTNLSGGITVHFTNDSGNRDVQVDYIQVNGQTRQSEQQSYNTGLYANGSCGGGGYSEWMHCNGAIGYGNTP

SEQ ID NO: 217 - DNA, 1083 bp, Unknown
  Obtained from an environmental sample
atgactttcgtcaagacgatcaccggcagacgcgccatcgcggcgttcctctgcctcgccggcctctacatggcgccggcaaacgcgcaaacctgcatcacgtccagccagaccggcaccaacaacgggaactacttttcgttctggaaagacagcccgggcacggtgaacttctgcatgtacccgaatggccgctacacctcgaactggagcggcatcaacaactgggtcggcggcaagggctggtcgaccggctccagccgcaccgtcagctattcgggcagcttcaattcgcccggcaacggctacctgactctctacgggtggaccaccaacccgctcatcgagtactacatcgtcgagaactggggtaactaccgcccgccgggcggccaggggtacatggggaccgtcaattccgacggggcgacctatgacatctaccggaccttccgggacaaccagccctgcatcacgggcaactcctgcgacttctaccagtactggagcgtgcgccagtccaagcgcagcagcggcaccatcaccacggccaatcacttcgcggcgtggaacagcctcggcatgaacctgggccagcacaactaccaggtcatggccaccgagggttaccagagcagcggcagctccgacatcacggtcacggaaggcggcggcggcagcagcaatggtggcagcagcaacggcggcagcagcaatggcggcagcagcaatggcggcggcggcggcaccaagagcttcacggtccgcgcccgtggcaccgcgggtggcgagtccatcacgctgcgtgtcaacaaccagaacgtgcagacctggacgctgggcaccggcatgcagaactacacggcctcgacctcgctgagcggtggcatcacggtgcacttcaccaacgacggcggaagccgcgacgtgcaggtggactacatccaggtgaacggcagcacgcgccagtccgaggcacagagctacaacaccggcgcctacctgaacggccgttgcggcggtggcggcaacagcgaatggatgcattgcaacggcgccatcggctacggcaatacgccctga

SEQ ID NO: 218 - protein, 360 aa, Unknown
  Obtained from an environmental sample
  SIGNAL (1)...(29)
MTFVKTITGRRAIAAFLCLAGLYMAPANAQTCITSSQTGTNNGNYFSFWKDSPGTVNFCMYPNGRYTSNWSGINNWVGGKGWSTGSSRTVSYSGSFNSPGNGYLTLYGWTTNPLIEYYIVENWGNYRPPGGQGYMGTVNSDGATYDIYRTFRDNQPCITGNSCDFYQYWSVRQSKRSSGTITTANHFAAWNSLGMNLGQHNYQVMATEGYQSSGSSDITVTEGGGGSSNGGSSNGGSSNGGSSNGGGGGTKSFTVRARGTAGGESITLRVNNQNVQTWTLGTGMQNYTASTSLSGGITVHFTNDGGSRDVQVDYIQVNGSTRQSEAQSYNTGAYLNGRCGGGGNSEWMHCNGAIGYGNTP

SEQ ID NO: 219 - DNA, 1029 bp, Unknown
  Obtained from an environmental sample
atgacatcaggtctcaagaaagtgatggcattcgtctgtctcgccacccttggcgtttcggcgcatgcccagacatgtattcagtccagtcagaccggcaccaacaacggattctatttctccttctggaaggacaacccgggcacggtgcagttctgcctgcagagcggcggtcgttacacctccaactggaacggcatcaacaactgggtgggcggcaaggggtggcagaccggcgcacgccgcacggtgaactactcgggctcgttcaactcgccgggcaacggctatctggcgctgtacggctggaccaccaatccgctggtcgagtactacatcgtcgacagctggggcagcttccgtccgccgggcaacactgcaggcctgtgggtactggtgaacagcgatggcggcacctacgacatctatcgcgcgcatcgcagtaacgcgccctgcatcaccggcagcagctgcgacttcgaccagtactggagcgtgcgacagtcgaagcgcgtcggcggcaccatcaccaccggcaaccacttcgatgcctgggcgaaccaccagatgaatctgggccagttcaactaccagatcatggctaccgagggtttccagagcaacggcagctccgacatcaccgtcagtgaatgcaccagcaattgcggcggtggcggcggcggcgggggtggcagcaacagcatcacggtgcgcgcgcgcggcacgggcggcggcgagcagatccggctgcgggtgaacaacaccacggtgcaaacctggacgctgaccaccagctaccagaacttcacggcttcgacctcgctgagcggcggcaccatcgtcgagtacttcaacgacagttccggccatgacgtgcaggtcgactacatcatcgtgaatggcgtgacccgccagtccgaatcgcagagctacaacaccgggctgtatgccaacgggcgttgcggcggcggctccaacagcgagtggatgcattgcaacggtgccattggatacggaaataccccgtaa

SEQ ID NO: 220 - protein, 342 aa, Unknown
  Obtained from an environmental sample
  SIGNAL (1)...(23)
MTSGLKKVMAFVCLATLGVSAHAQTCIQSSQTGTNNGFYFSFWKDNPGTVQFCLQSGGRYTSNWNGINNWVGGKGWQTGARRTVNYSGSFNSPGNGYLALYGWTTNPLVEYYIVDSWGSFRPPGNTAGLWVLVNSDGGTYDIYRAHRSNAPCITGSSCDFDQYWSVRQSKRVGGTITTGNHFDAWANHQMNLGQFNYQIMATEGFQSNGSSDITVSECTSNCGGGGGGGGGSNSITVRARGTGGGEQIRLRVNNTTVQTWTLTTSYQNFTASTSLSGGTIVEYFNDSSGHDVQVDYIIVNGVTRQSESQSYNTGLYANGRCGGGSNSEWMHCNGAIGYGNTP

SEQ ID NO: 221 - DNA, 1044 bp, Unknown
  Obtained from an environmental sample
atgattgttagtttcaagagcgtgaaggcactcgcgtgcctggccgtgctcggcgtgaccgccgcgcaggcgcaaacctgcatcaattccagccagaccggcaccaacaacggcaattatttttcattctggaaagacaacccgggcacggtgaccttctgcatgtatgccaacggccgctacacctccaactggagcggcatcaacaactgggtgggtggcaagggctggcagaccggctcgaatcgcacggtgacctactccggttcgttcaactcgcccggcaacggctacctcaccctgtacgggtggaccacgaatccgctgatcgagtactacatcgtcgacagttggggcagttatcgaccgcccggcggccagggcttcatgggcaccgtgacgaccgacggcggcacctacgacatctatcgcacgcagcgcgtgaaccagccttccatcatcggcaccgcgacgttctaccagtactggagcgtgcggcagtcgaagcgcgtggggggcaccatcaccaccgccaaccacttcaatgcctgggcgacgctgggcatgaacctgggccagcacaactaccaggtcatggccaccgagggttaccagagcagcggcagctccgacatcaccgtgaccgaaggcggcggcagctcgtcgtcgtcgagcggcggcggcagcaccagcagcggcggtggcggcagcaagagcttcacggtgcgcgcccgcggcacggtcggcggcgaaaacatccagctgcaggtcaacaaccagacggtggcgagctggaacctgaccaccagcatgcagaactacaacgcctcgaccagcctgagtggcggcatcaccgtggtctacaccaacgacggcggtaaccgcgacgtccaggtcgactacatcaccgtgaacggccagacccgccagtccgaagcgcagagtttcaacaccgggctgtatgccaacggacgttgtggcggcggctcgaacagcgagtggatgcattgcaatggcgcgatcggctacggcaacacgccgtaa

SEQ ID NO: 222 - protein, 347 aa, Unknown
  Obtained from an environmental sample
  SIGNAL (1)...(24)
MIVSFKSVKALACLAVLGVTAAQAQTCINSSQTGTNNGNYFSFWKDNPGTVTFCMYANGRYTSNWSGINNWVGGKGWQTGSNRTVTYSGSFNSPGNGYLTLYGWTTNPLIEYYIVDSWGSYRPPGGQGFMGTVTTDGGTYDIYRTQRVNQPSIIGTATFYQYWSVRQSKRVGGTITTANHFNAWATLGMNLGQHNYQVMATEGYQSSGSSDITVTEGGGSSSSSSGGGSTSSGGGGSKSFTVRARGTVGGENIQLQVNNQTVASWNLTTSMQNYNASTSLSGGITVVYTNDGGNRDVQVDYITVNGQTRQSEAQSFNTGLYANGRCGGGSNSEWMHCNGAIGYGNTP

SEQ ID NO: 223 - DNA, 642 bp, Unknown
  Obtained from an environmental sample
atgtttaagtttaaaaagaatttcttagttggattatcggcagctttaatgagtattagcttgttttcggcaaccgcctctgcagctagcacagactactggcaaaattggactgatgggggcggtatagtaaacgctgtcaatgggtctggcgggaattacagtgttaattggtctaataccggaaatttcgttgttggtaaaggttggactacaggttcgccatttaggacgataaactataatgccggagtttgggcaccgaatggaaatggatatttaactttatatggttggacgagatcacctctcatagaatattatgtagtggattcatggggtacttatagacctactggaacgtataaaggtactgtaaaaagtgatgggggtacatatgacatatatacaactacacgttataacgcaccttccattgatggcgatcgcactacttttacgcagtactggagtgttcgccaaacgaagagaccaaccggaagcaacgctacaatcactttcagcaatcatgttaacgcatggaagagccatggaatgaatctgggcagtaattgggcttaccaagtcatggcgacagaaggatatcaaagtagtggaagttctaacgtaacagtgtggtaa

SEQ ID NO: 224 - protein, 213 aa, Unknown
  Obtained from an environmental sample
  SIGNAL (1)...(28)
MFKFKKNFLVGLSAALMSISLFSATASAASTDYWQNWTDGGGIVNAVNGSGGNYSVNWSNTGNFVVGKGWTTGSPFRTINYNAGVWAPNGNGYLTLYGWTRSPLIEYYVVDSWGTYRPTGTYKGTVKSDGGTYDIYTTTRYNAPSIDGDRTTFTQYWSVRQTKRPTGSNATITFSNHVNAWKSHGMNLGSNWAYQVMATEGYQSSGSSNVTVW

SEQ ID NO: 225 - DNA, 1059 bp, Unknown
  Obtained from an environmental sample
atgtttgttagtctcaggaagacggcttgggcgtgcctgttgctcgccggcctcggaatctcgacttcacaagcccagacctgcatcacgtccagcgggacgggcaccaacaacggccactactattccttctggaaggacagtggcggcaccgtcaacttctgcatgtacgcgaacggccgctacacctccaactggagcggcatcaacaactgggtgggcggcaagggctggcagaccggctcacgccggacgatcagctactcgggctcgttcaactcacccggcaatggttatctcaccctgtacggttggaccaccaatccattgatcgagtactacatcgtcgacaactggggcacgtaccggccgccgggaggctcgggctacatgggcacggtgacgagcgacggcggcacctacgacgtctatcgcacccagcgcgtaaaccagccttccatcatcggcaccgcgacgttctatcaatactggagcgtgcgccagcagaagcggaccggcgggaccatcaccaccggcaatcacttcgacgcctgggccgcatacggaatgaacctcggcacccacaactaccagatcatggcgaccgagggttaccagagcagcggcagttcggacatcacggtgagcgagggcggtggcagttcatcgagcagcagctcgtcgagcagcagcagttcgtcctcttcgagcggcggcggcggcacgaagagcttcacggtccgcgcgcgcggcacggcgggcggtgaatccatcacgctgcgcgtgaacaaccagaacgtgcagacctggacgctgggcacgtcgatgcagaactacaccgcatcgaccacgctctccggtggcatcaccgtcgcgtacaccaacgacagcggcaatcgcgacgtgcaggtggactacatcgtcgtgaacggcgccacccgccagtccgaggcgcagagctacaacaccggtctctatgccaacggtcgttgcggcggcggctccaacagcgagtggatgcactgcaacgggcagatcggctacgggaatactccctag

SEQ ID NO: 226 - protein, 352 aa, Unknown
  Obtained from an environmental sample
  SIGNAL (1)...(25)
MFVSLRKTAWACLLLAGLGISTSQAQTCITSSGTGTNNGHYYSFWKDSGGTVNFCMYANGRYTSNWSGINNWVGGKGWQTGSRRTISYSGSFNSPGNGYLTLYGWTTNPLIEYYIVDNWGTYRPPGGSGYMGTVTSDGGTYDVYRTQRVNQPSIIGTATFYQYWSVRQQKRTGGTITTGNHFDAWAAYGMNLGTHNYQIMATEGYQSSGSSDITVSEGGGSSSSSSSSSSSSSSSSSGGGGTKSFTVRARGTAGGESITLRVNNQNVQTWTLGTSMQNYTASTTLSGGITVAYTNDSGNRDVQVDYIVVNGATRQSEAQSYNTGLYANGRCGGGSNSEWMHCNGQIGYGNTP

SEQ ID NO: 227 - DNA, 747 bp, Unknown
  Obtained from an environmental sample
atgggcggcacgactggtagtggcggctcagccgccgccggcgcaggcacgagtggaagcgcgggcggtaccgccggagcgctcggccccggcggtacccagggcagcggtggcgcagccggtggtacgagcggaacgggcggggccatcagcagcagctgcacggaagctgacaagacggtctgcaacaacgaaaccggtcgccactgcaattacacgtacgagtattggaaggaccagggaagcggttgcctcgtgaacaaagccgacggcttcagcgtcaactggaacaacatcaacaatctgctgggtcgcaagggtctgaggcccggatcgtcgaatcagacggtgacctaccaggcaaactaccagccgaacggcaattcatacctgtgcgtatatggatggacgcaaaaccccctcgtcgaatactacatcgtcgatagctggggcagctggcgcccgccggggggaacgtccatgggcaccgtcaacgcggacggcggcacctacgacatctaccgcacccagcgcgtcaaccagccttccatcgaaggcaccaagaccttctatcaatactggagcgttcgcactcagaagcgcacgagcggaacgatcacggttgccgctcacttcgacgcctgggcgacgaaggggatgaacatggggagtctgtacgaggtgtcgatgaccgtcgagggctatcaaagcagcgggaccgccgacgtgagcttctcgatgaagtga

SEQ ID NO: 228 - protein, 248 aa, Unknown
  Obtained from an environmental sample
  SIGNAL (1)...(39)
MGGTTGSGGSAAAGAGTSGSAGGTAGALGPGGTQGSGGAAGGTSGTGGAISSSCTEADKTVCNNETGRHCNYTYEYWKDQGSGCLVNKADGFSVNWNNINNLLGRKGLRPGSSNQTVTYQANYQPNGNSYLCVYGWTQNPLVEYYIVDSWGSWRPPGGTSMGTVNADGGTYDIYRTQRVNQPSIEGTKTFYQYWSVRTQKRTSGTITVAAHFDAWATKGMNMGSLYEVSMTVEGYQSSGTADVSFSMK

SEQ ID NO: 229 - DNA, 642 bp, Unknown
  Obtained from an environmental sample
atgtttaagtttacaaagaaattcttagttgggttaacggcagctttgatgagtattagcttgttttcggcaaacgcctctgcagctaacacagactactggcaaaattggactgatgggggcggaacagtaaacgctgtcaatgggtctggcgggaattacagtgtgaattggtctaataccgggaatttcgttgttggtaaaggttggactacaggttcgccatttaggacgataaactataatgccggagtttgggcgccgaatggcaatgcatatttgactttatatggttggacgcgatcacccctcatagaatattatgtagtggattcatggggtacttatagacctactggaacgtataaaggtacggtttacagtgatgggggtacatatgacgtgtacacaactacacgttatgatgcaccttccattgatggcgataaaactacttttacgcagtactggagtgttcgccagtcgaagagaccaactggaagcaacgctacaatcactttcagcaatcacgttaacgcatggaagagatatgggatgaatctgggtagtaattggtcttaccaagtcttagcgacagagggatatcaaagtagtggaagttctaacgtaacagtgtggtaa

SEQ ID NO: 230 - protein, 213 aa, Unknown
  Obtained from an environmental sample
  SIGNAL (1)...(28)
MFKFTKKFLVGLTAALMSISLFSANASAANTDYWQNWTDGGGTVNAVNGSGGNYSVNWSNTGNFVVGKGWTTGSPFRTINYNAGVWAPNGNAYLTLYGWTRSPLIEYYVVDSWGTYRPTGTYKGTVYSDGGTYDVYTTTRYDAPSIDGDKTTFTQYWSVRQSKRPTGSNATITFSNHVNAWKRYGMNLGSNWSYQVLATEGYQSSGSSNVTVW

SEQ ID NO: 231 - DNA, 1008 bp, Bacteria
atgaacctgctcgtccagccgaggcgtcgcagacgcggtccggtcaccttgctcgtcaggagcgcgtgggccgtcgcgctggcggcgctcgccgcgctgatgctgccgggcaccgcccaggccgacacggtcgtcacgaccaaccaggagggcaccaacaacggctactactactcgttctggaccgacagccagggcaccgtctccatgaacatgggctccggcggtcagtacagcacctcgtggcgcaacaccggcaacttcgtcgcgggcaagggctgggccaacggcggccgccggaccgtgcagtactcgggcagcttcaacccctccggcaacgcgtacctggcgctctacggatggacgtcgaacccgctcgtcgagtactacatcgtcgacaactggggcacctaccggcccacgggcgagtacaagggcaccgtcaccagcgacggcggcacctacgacatctacaagacgacccgcgtcaacaagccctccgtcgagggcacccgcaccttcgaccagtactggagcgtccggcaggcgaagcggaccggcggcaccatcacgaccggcaaccacttcgacgcgtgggcccgggccgggatgccgctcggcaacttcagctactacatgatcatggccaccgagggctaccagagcagcggcagctccagcatcaacgtcggcgggaccggccgcggcgacaacggcggcggcgacaacgggggcggtggcggcgggtgcaccgccacggtgtccgccgggcagaagtggggcgaccggtacaacctcgacgtctccgtcagcggcgccagcgactggacggtgacgatgaacgtgccgtccccggcgaaggtcctgtcgacctggaacgtcaacgccagctatcccagtgcgcagacgctgaccgccaggtcgaacggcagcggcaacaactggggcgccaccatccaggccaacggcaactggacctggcccagcgtgtcctgcagcgcgggctga

SEQ ID NO: 232 - protein, 335 aa, Bacteria
  SIGNAL (1)...(41)
MNLLVQPRRRRRGPVTLLVRSAWAVALAALAALMLPGTAQADTVVTTNQEGTNNGYYYSFWTDSQGTVSMNMGSGGQYSTSWRNTGNFVAGKGWANGGRRTVQYSGSFNPSGNAYLALYGWTSNPLVEYYIVDNWGTYRPTGEYKGTVTSDGGTYDIYKTTRVNKPSVEGTRTFDQYWSVRQAKRTGGTITTGNHFDAWARAGMPLGNFSYYMIMATEGYQSSGSSSINVGGTGRGDNGGGDNGGGGGGCTATVSAGQKWGDRYNLDVSVSGASDWTVTMNVPSPAKVLSTWNVNASYPSAQTLTARSNGSGNNWGATIQANGNWTWPSVSCSAG

SEQ ID NO: 233 - DNA, 1071 bp, Unknown
  Obtained from an environmental sample
atgtctatgtttttgagtctcaaaagagtggcggcgctcgtctgcgtcgcagggtttggcatttcggcggcgaacgctcagtgcgtcacttcgagccagacaggaaccaacaacgggttctatttttcgttctggaaagatagtccgggaaccgtgaatttctgcaaccagagcggtggccgctacacatccaattggagcggtatcaacaactgggtcggtggcaagggttggcagaccggctcgcgaagggtcgtgagctactccggttcgttcaattcgccgggcaacgggtatctgaccctctatgggtggaccaccaatccgctcatcgagtactacatcgtcgacaactggggctcgtatcgcccgccgggcggacaggggttcatgggcacggtgaccagcgacggcggcacgtacgatgtctaccgcacacagcgcgtcaatcaaccctgcatcaccggcagcagttgcaccttctatcaatactggagcgtgcggcagtcgaagagaacgggcggcacgatcacgacgggcaatcactttgacgcgtgggcgagttacggcatgaacctgggcgctcacaactaccagatcatggcgaccgagggttatcaaagcagcgggagctctgacatcacggtcagtgaaggcagcagcagtagcagcagtagcagcagttcgagcagtagctcgagcagcagctccagcagcagcagcggcggcggtggcaccaagagcttcacggtccgcgcgcgcggcgtggccggcggggaatccatcacgttgcgcgtgaacaatcagaacgtgcagacctggactctcggcaccggcatgcagaactacacggcgtcgacgtctttgagtggcggcatcacggttgcgtataccaacgatggcggcagtcgcgacgtgcaggttgactacatcatcgtgaacggccagacgcgtcagtcggaagcgcagagctacaacaccgggctttatgccaacggccgttgcggtggcggcggcaacagcgaatggatgcattgcaatggcgccattggctacgggaacacgccgtag

SEQ ID NO: 234 - protein, 356 aa, Unknown
  Obtained from an environmental sample
  SIGNAL (1)...(26)
MSMFLSLKRVAALVCVAGFGISAANAQCVTSSQTGTNNGFYFSFWKDSPGTVNFCNQSGGRYTSNWSGINNWVGGKGWQTGSRRVVSYSGSFNSPGNGYLTLYGWTTNPLIEYYIVDNWGSYRPPGGQGFMGTVTSDGGTYDVYRTQRVNQPCITGSSCTFYQYWSVRQSKRTGGTITTGNHFDAWASYGMNLGAHNYQIMATEGYQSSGSSDITVSEGSSSSSSSSSSSSSSSSSSSSSSGGGGTKSFTVRARGVAGGESITLRVNNQNVQTWTLGTGMQNYTASTSLSGGITVAYTNDGGSRDVQVDYIIVNGQTRQSEAQSYNTGLYANGRCGGGGNSEWMHCNGAIGYGNTP

SEQ ID NO: 235 - DNA, 1539 bp, Unknown
  Obtained from an environmental sample
atgtcgaataacagatttgtgctgaatcgtgttgctgcaggtttgctgctgggtttctcgctgctgtcatcagcagccatcgcccagaatgtggtggtaaatccttctacggtccatcagaccgtgcgcggctttggcggcatgaacgcgccgggctggattgatgaccttaccaccgcccaggtcaataaggcctatggcagtggcgatggccaggtcgggctctccatcatgcgcatgcgcattgatccgaactcggcagcctggaatatccaggtgccggctgccaagcgggccaaggagctgggtgcgatcctgtttgccacgccctggtcgccgcccgcctacatgaaatccaacaaaagcctgaataacggcggcaagctgctgcccgagtattacagcgcctacaccacccacctgctggattttgcgagtttcatgtcgcgcaacggcgcaccgctgtatgcgatttcaatccagaacgaaccggactggctgccggattatgagtcgtgtgcctggactggtactgatttcgtcaattatctgaatacccagggctcgcgttttggtgatctgaaagtgattgcgccggaatccctgggtttcacgacctcgtattccgaccccatcctcaacagcgccacggcagcgccgcatgtcgacatcatcggcggccacctctacggcgtgctgcccaaggactacccgctggcgcgccagaagggcaaggaaatctggatgaccgagcattacaccgagagcaagaactcgggtgatgcctggccgctggcgctggacgtaggcaccgagctgcaccagagcatggtggccaactacaacgcctacgtgtggtggtatgtgcgccgcagctacggcctgctgctggagaacggcaatgtgagcaagcgcggctacatcatgtcgcagtacgcacgcttcgtccgccccggctccaagcgcatcggcgcgacggaaaagccgcacgccgacgtggcggtgacggcctacaagacgccggataaccgcattgtgctggtggcggtgaataccggtgcggcgcaccgtcagctgaacatcacggtgccgagcggcagcgtgggttctttcagcaagttctccacttccggcacgctgaatgtgggcagtggtggcagctacaaggtcaacaacggcgcggtgagcctgtacatcgatccgcagagcgtggccacgctggtgggtgatctgcccggcacggcctccagctcttcggcggcgtcctcgtcctcttccagtgcagccagctctgcttcgagcagtgctagcggcgcaccggccctgtctggcagcagcgattaccccacgggcttcagcaagtgcgctgatctgggtggtacttgtgccgtgccttcgggctcgggctggacggctttcgggcgcaagggcaagtgggttgccaagtacgtcggtgtgggcaagagcattgcctgcacggtgacggctttcggcagcgatcccggtggtgcacccaacaagtgttcttaccagaagtaa

SEQ ID NO: 236 - protein, 512 aa, Unknown
  Obtained from an environmental sample
  SIGNAL (1)...(28)
MSNNRFVLNRVAAGLLLGFSLLSSAAIAQNVVVNPSTVHQTVRGFGGMNAPGWIDDLTTAQVNKAYGSGDGQVGLSIMRMRIDPNSAAWNIQVPAAKRAKELGAILFATPWSPPAYMKSNKSLNNGGKLLPEYYSAYTTHLLDFASFMSRNGAPLYAISIQNEPDWLPDYESCAWTGTDFVNYLNTQGSRFGDLKVIAPESLGFTTSYSDPILNSATAAPHVDIIGGHLYGVLPKDYPLARQKGKEIWMTEHYTESKNSGDAWPLALDVGTELHQSMVANYNAYVWWYVRRSYGLLLENGNVSKRGYIMSQYARFVRPGSKRIGATEKPHADVAVTAYKTPDNRIVLVAVNTGAAHRQLNITVPSGSVGSFSKFSTSGTLNVGSGGSYKVNNGAVSLYIDPQSVATLVGDLPGTASSSSAASSSSSSAASSASSSASGAPALSGSSDYPTGFSKCADLGGTCAVPSGSGWTAFGRKGKWVAKYVGVGKSIACTVTAFGSDPGGAPNKCSYQK

SEQ ID NO: 237 - DNA, 1269 bp, Unknown
  Obtained from an environmental sample
atgattccacgcataaaaaaaacaatttgtgtactattagtatgtttcactatgctgtcagtcatgttagggccaggcgctactgaagttttggcagcaagtgatgtaacagttaatgtatctgcagagaaacaagtgattcgcggttttggagggatgaatcatccggcttgggctggggatcttacagcagctcaaagagaaactgcttttggcaatggacagaaccagttaggattttcaatcttaagaattcatgtagatgaaaatcgaaataattggtataaagaggtggagactgcaaagagtgcggtcaaacacggagcaatcgtttttgcttctccttggaatcctccaagtgatatggttgagacctttaatcggaatggtgacacatcggctaaacggctgaaatacaacaagtacgcagcatacgcgcagcatcttaacgattttgttaccttcatgaagaataatggtgtgaatctttacgcgatttcggtccaaaacgagcctgattacgctcacgagtggacgtggtggacgccgcaagaaatacttcgctttatgagagaaaacgccggctcgatcaatgcccgcgtcattgcgcctgagtcatttcaatacttgaagaatttgtcggacccgatcttgaacgatccgcaggctcttgccaatatggatattctcggaactcacctgtacggcacccaggtcagccaattcccttatcctcttttcaaacaaaaaggagcggggaaggacctttggatgacggaagtatactatccaaacagtgataccaactcggcggatcgatggcctgaggcattggatgtttcacagcatattcacaatgcgatggtagagggggactttcaagcttatgtatggtggtacatccgaagatcatatggacctatgaaagaagatggtacgatcagcaaacgcggctacaatatggctcatttctcaaagtttgtgcgtcccggctatgtaaggattgatgcaacgaaaaaccctaatgcgaacgtttacgtgtcagcctataaaggtgacaacaaggtcgttattgttgccatcaataaaagcaacacaggagtcaaccaaaactttgttttgcagaatggatctgcttcaaacgtatctagatggatcacgagcagcagcagcaatctacaacctggaacgaatctcactgtatcaggcaatcatttttgggctcatcttccagctcaaagcgtgacaacatttgttgtaaatcgttaa

SEQ ID NO: 238 - protein, 422 aa, Unknown
  Obtained from an environmental sample
  SIGNAL (1)...(32)
MIPRIKKTICVLLVCFTMLSVMLGPGATEVLAASDVTVNVSAEKQVIRGFGGMNHPAWAGDLTAAQRETAFGNGQNQLGFSILRIHVDENRNNWYKEVETAKSAVKHGAIVFASPWNPPSDMVETFNRNGDTSAKRLKYNKYAAYAQHLNDFVTFMKNNGVNLYAISVQNEPDYAHEWTWWTPQEILRFMRENAGSINARVIAPESFQYLKNLSDPILNDPQALANMDILGTHLYGTQVSQFPYPLFKQKGAGKDLWMTEVYYPNSDTNSADRWPEALDVSQHIHNAMVEGDFQAYVWWYIRRSYGPMKEDGTISKRGYNMAHFSKFVRPGYVRIDATKNPNANVYVSAYKGDNKVVIVAINKSNTGVNQNFVLQNGSASNVSRWITSSSSNLQPGTNLTVSGNHFWAHLPAQSVTTFVVNR

SEQ ID NO: 239 - DNA, 1281 bp, Unknown
  Obtained from an environmental sample
atgaatcgtttcttgatttcacgttataagaaagccataagtgcatgtttggcccttgtccttgcgttgtctctcatggcggcacctggcgatgttgccgcagccagcgacgccgttataaatgtatcgtcggagaaacaagtgatacgcggtttcggaggcatcaaccacccggcatggatcggagatttgacggcagcacagagagaaaccgcatttgggaacgggccaaatcagttaggcttctcgatattaagaatctacgtgcatgaagaccgaaatcagtggcaccgtgaactggatacggccaaacgagcgattgcccttggagctatcgtattcgcttcgccatggaatccgcccgccgacatggtcgagaccttcaaccgcaacggcgatacgtcggcaaagcgacttcgttacgacaagtataccgcctatgcccagcatcttaacgatttcgtaacctacatgagaaacaatggcgtgaatctctacgcgatttccgtccagaacgagcccgattatgcgcatgactggacgtggtggactccgcaggaaatgcttcgctttatgaaagaaaatgccggatcgatcaacagcagagtgatcgcaccggaatcgttccaatatctgaaaaatatgtcggacccgattctaaatgatccccaggcgcttgccaatatggatattcttggcgctcatctgtacggtacccaagttagcaatttcgcgtatccactattcaaacaaaaaggagcgggaaaagacctctggatgaccgaggtgtattacccgaacagcgacaacaactcggcggatcgctggcccgaagccctggatgtgtcttaccatatccacaatgcgatggtagagggagattttcaagcttatgtatggtggtatatccgcagatcctatggtccaatgaaagaggacggcacgatcagcaaacgcggctacaatatggctcatttctccaagtttgtccgtcccggctatgtcagggtggatgcttcgaaaaatccagaaacgaacgtttacgtatccgcatataaaggcgacaacaaaatcgttatcgttgccataaaccggaacaactccggggtcaatcagaactttgtccttcagaatggatccgtttcgcaggtatcaaggtggatcacgagcagcagcagcaatctccagccaggaacgtctctcaatgtaacagggagcaatttctgggctcatcttcccgcgcaaagcgttacgacttttgtgggtgaactcggaaggtaa

SEQ ID NO: 240 - protein, 426 aa, Unknown
  Obtained from an environmental sample
  SIGNAL (1)...(30)
MNRFLISRYKKAISACLALVLALSLMAAPGDVAAASDAVINVSSEKQVIRGFGGINHPAWIGDLTAAQRETAFGNGPNQLGFSILRIYVHEDRNQWHRELDTAKRAIALGAIVFASPWNPPADMVETFNRNGDTSAKRLRYDKYTAYAQHLNDFVTYMRNNGVNLYAISVQNEPDYAHDWTWWTPQEMLRFMKENAGSINSRVIAPESFQYLKNMSDPILNDPQALANMDILGAHLYGTQVSNFAYPLFKQKGAGKDLWMTEVYYPNSDNNSADRWPEALDVSYHIHNAMVEGDFQAYVWWYIRRSYGPMKEDGTISKRGYNMAHFSKFVRPGYVRVDASKNPETNVYVSAYKGDNKIVIVAINRNNSGVNQNFVLQNGSVSQVSRWITSSSSNLQPGTSLNVTGSNFWAHLPAQSVTTFVGELGR

SEQ ID NO: 241 - DNA, 1695 bp, Unknown
  Obtained from an environmental sample
gtgaagatattgaaatttaagatgaatttaaaaaaatcggttcatgttctgttggcctgtttaacagccctgcctctcatgttaacgccgacacacgtatcagcagcaagtgatgccaacattaatttgtcctccgaaaaacagcttatcaaggggtttggaggtattaaccacccagcctggattggcgacttgacggcagctcagcgtgaaacagcctttggcaacggagcgaaccagcttggtttttccatactaagaatctatgtcgatgaaaatccaaacaactggtacagggaggtggctactgccaaaagagccatagagcaaggtgccatcgtattcgcttctccctggaatccaccaagtgacatggtcgaaaccttcaatcggaacggggatacgaacgccaaacgattgagatacgacaaatatgctgcgtacgcgcagcatctgaacgactttgtcagttatatgaaaaataacggtgtggatctgtatgccatttcggtacaaaatgagccggattatgcccatgaatggacctggtggactccgcaggagatccttcgtttcatgaaggagaatgcgggatccattcagaataccaaagtcatggcacctgaatcgttccagtatttgaaaaacatgtctgacccgattctgaatgatcctcaggcactcgccaatatggacattctgggagctcatacgtacgggacacagttcaaagatttcgcatacccgctctttaagcaaaagggagccggcaaagaactgtggatgacagaagtgtattacccgaacagcgataacaactcgtcggaccgttggcctgaggcattggacgtatcttaccatatgcataatgccatggttgaaggagattttcaggcttacgtatggtggtatattcggagacagtacggtccgatgaatgagaacgggactattagcaaacgtggttacaatatggcccatttctccaaatttgtgcgaccaggctattaccgtgtcgatgcaaccaaaaatccggataccaataccttcgtctcagcctataaaggtgataataaggcagtcattgtggcgattaatcgcggcacctcggctgtaagccaaaaattcgttcttcagaatggtaacgcttctactgtatcctcttgggttacggatagcagccgaaacctggcaagcggagcgccgattacgatgtcaggtggagcctttacagcacaactgccagcccaaagcgtaacaacgtttgtagccaacattactggtggtagtgtcactccaggcagcggaaccacgtacgaggcggaaacgggcactacacttaccgatgccgtgatcgagactctctacccgggatacactgggaccggatacgtgaactttaatgcgtatactggttcggccattcaatggaatgccatcaataacacgataacaggtaccaaaaatgtgaaatttcgttacgcccaggaaagcggaacgcgtaatctcgacattttcgttaacggaactaaagtcatcagcaacgaacctttcccggcaacaggcagctggtcgacctggagtgaaaaaactattcaggtccccatgaacgcgggaaccaatacgattaaagtggtcacaaccggtacagaagggccaaatattgataacatcaatgtcactgcagtccaataa

SEQ ID NO: 242 - protein, 564 aa, Unknown
  Obtained from an environmental sample
  SIGNAL (1)...(28)
VKILKFKMNLKKSVHVLLACLTALPLMLTPTHVSAASDANINLSSEKQLIKGFGGINHPAWIGDLTAAQRETAFGNGANQLGFSILRIYVDENPNNWYREVATAKRAIEQGAIVFASPWNPPSDMVETFNRNGDTNAKRLRYDKYAAYAQHLNDFVSYMKNNGVDLYAISVQNEPDYAHEWTWWTPQEILRFMKENAGSIQNTKVMAPESFQYLKNMSDPILNDPQALANMDILGAHTYGTQFKDFAYPLFKQKGAGKELWMTEVYYPNSDNNSSDRWPEALDVSYHMHNAMVEGDFQAYVWWYIRRQYGPMNENGTISKRGYNMAHFSKFVRPGYYRVDATKNPDTNTFVSAYKGDNKAVIVAINRGTSAVSQKFVLQNGNASTVSSWVTDSSRNLASGAPITMSGGAFTAQLPAQSVTTFVANITGGSVTPGSGTTYEAETGTTLTDAVIETLYPGYTGTGYVNFNAYTGSAIQWNAINNTITGTKNVKFRYAQESGTRNLDIFVNGTKVISNEPFPATGSWSTWSEKTIQVPMNAGTNTIKVVTTGTEGPNIDNINVTAVQ

SEQ ID NO: 243 - DNA, 1272 bp, Unknown
  Obtained from an environmental sample
atgatttcaagcgtaaaaaaaccaatttgtgtattattggtatgtttcactatgctgtcagtcatgttagccgggccaggtgctactgaagttttagcagcaagtgatgtaacaattaatttatctgcagaaaaacaagtgatccgcggttttggaggcatgaaccacccggcttggattggagatttgacagcagctcaaagagaaaccgcttttggcaatggacagaatcagttaggtttttcaatcttaagaattcatgtggatgaaaatagaaataattggtacagagaagtggagactgcaaagagtgcgatcaaacatggagcaatcgtttttgcttctccctggaatcctccaagcgatatggttgagactttcaatcgtaatggtgacacatcagctaaacggctaagatacgataagtacgccgcatacgcgcagcatcttaacgattttgttacctacatgaagaataatggcgtgaatctttatgcgatttctgttcaaaacgagcctgattatgcgcacgaatggacgtggtggactccgcaagaaatacttcgtttcatgagagaaaatgccggttccattaatgcacgtgtcattgcaccagaatcttttcagtactttaaaaatatatcggaccccattttgaacgatccacaggcgcttaggaatatggatattctcggaactcacctgtacggtactcaggtcagtcagtttccttatcctctattcaaacaaaaaggagcagggaaagagctatggatgacggaagtatactatccaaacagtgacaacaattcagcggatcgctggcccgaggcattaggcgtttcagagcatattcaccattcaatggtggagggagattttcaatcttatgtttggtggtacatccgcagatcttacggtcctatgaaagaggacggtacgatcagcaaacgcggttacaatatggctcatttctcgaagtttgtgcgtcccggctatgtaagggtagatgcaacgaaaaatcctaatgcgaacgtttacgtgtcagcctataaaggtgacaacaaggtcgttattgttgccattaacaaaagcaatacaggggtcaaccaaaactttgtgttgcagaatggatctgcttctcaggtatctaggtggataacaagcggaagcagcaatcttcaacctggaacgaatctcaatgtaacgggcaatcatttttgggcccatcttccagctcaaagcgtgacaacatttgtcgcaaatcgttaa

SEQ ID NO: 244 - protein, 423 aa, Unknown
  Obtained from an environmental sample
  SIGNAL (1)...(33)
MISSVKKPICVLLVCFTMLSVMLAGPGATEVLAASDVTINLSAEKQVIRGFGGMNHPAWIGDLTAAQRETAFGNGQNQLGFSILRIHVDENRNNWYREVETAKSAIKHGAIVFASPWNPPSDMVETFNRNGDTSAKRLRYDKYAAYAQHLNDFVTYMKNNGVNLYAISVQNEPDYAHEWTWWTPQEILRFMRENAGSINARVIAPESFQYFKNISDPILNDPQALRNMDILGTHLYGTQVSQFPYPLFKQKGAGKELWMTEVYYPNSDNNSADRWPEALGVSEHIHHSMVEGDFQSYVWWYIRRSYGPMKEDGTISKRGYNMAHFSKFVRPGYVRVDATKNPNANVYVSAYKGDNKVVIVAINKSNTGVNQNFVLQNGSASQVSRWITSGSSNLQPGTNLNVTGNHFWAHLPAQSVTTFVANR

SEQ ID NO: 245 - DNA, 1263 bp, Unknown
  Obtained from an environmental sample
atgtcaatgatcaaaaaaccaatctgcactttattgatctgcttcaccatgctgtctgtcatgttcatcggacctggcgtgactgaggtttcagcagcagatgccaatattaatatcaatgcggaaagacaagtgattcgcggctttggcggaatgaaccatccggcttggattggtgatttgaccgcacctcaaagggaaaccgcctttggcaatgggcagaatcaattaggattttccattctaagaatttttgtagatgagaaccgaaataattggcacagagaggtcgctactgccaaaagagcaatagagcatggagctttggtgatcgcttcaccatggaatcctccaagcaatatggtagagaccttcaaccggaatggtacatctgcaaagcggctcagatacaaccaatacgccgcatatgctcagcatctgaacgattttgtgacgtatatgaaaaataatggcgtcaatctctatgctatatctgtacaaaatgagcccgattatgcacacgaatggacatggtggactcctcaggaaatcctgcgtttcatgagagaaaatgctggctccattaatgcccgcgtgatcgcaccagaatcctttcaataccttaaaaatatatcagatcctatcctaaacgatccgcaggcgcttggaaacatggacattctcggagcccatttgtacggaacccaaatcagccagcttccgtatcctcttttcaaacaaaagggagggggaaaggagctttggatgacagaggtctactacccgaatagcgataacaattcagcggaccgctggcctgaagcattaggggtttcagagcatattcaccattcgatggtagaaggggactttcaggcatatgtttggtggtacattcgcagatcctacggccctatgaaagaagacggtctaatcagcaaacgtggttacaacatggcgcatttctccaagtttgtacgcccaggatacatcagaattgatgcaacgaaaagtcctgaaccgaatgttttcgtatcagcctataaaggaaacaatcaagtcgtcattgtcgcgattaacaaaaacaatacaggagtcaatcagcactttgtgatgcaaaacggaactgcttcacaagcgtcaagatggatcacaagtagcaacagcaaccttcagcctggtacagacttaaatatatcaggtaatcaattttgggctcatctcccggctcaaagtgtgacaacatttgtggtcaaacgctag

SEQ ID NO: 246 - protein, 401 aa, Unknown
  Obtained from an environmental sample
  SIGNAL (1)...(32)
MSMIKKPICTLLICFTMLSVMFIGPGVTEVSAADANININAERQVIRGFGGMNHPAWIGDLTAPQRETAFGNGQNQLGFSILRIFVDENRNNWHREVATAKRAIEHGALVIASPWNPPSNMVETFNRNGTSAKRLRYNQYAAYAQHLNDFVTYMKNNGVNLYAISVQNEPDYAHEWTWWTPQEILRFMRENAGSINARVIAPESFQYLKNISDPILNDPQALGNMDILGAHLYGTQISQLPYPLFKQKGGGKELWMTEVYYPNSDNNSADRWPEALGVSEHIHHSMVEGDFQAYVWWYIRRSYGPMKEDGLISKRGYNMAHFSKFVRPGYIRIDATKSPEPNVFVSAYKGNNQVVIVAINKNNTGVNQHFVMQNGTASQASRWITSSNSNLQPGTDLNISG

SEQ ID NO: 247 - DNA, 1044 bp, Unknown
  Obtained from an environmental sample
gtgtttgccaacgatttcctgataggcgtggcgctcaactcacggcaggtcgccggggaatccgaggccggaaaactagctggcgcgcaattttcgtcggtgacggcggagaatgagatgaagtggcagtcgctccatccccagcccgaccgctatcagttcggcgcggcggactcctacatcgattttgccaaaaaacacaagatggcggtgatcggccacacgctcgtgtggcacagccagacacccggctgggtgttcgagggcaaggacggcaagccggcgacccgcgaggatctgctcaagcgcatgcgcgatcacatccacaccgtggccggacgctacaagggcaaggtgcgcggctgggacgtggtcaacgaggccttgtccgacggcggtcccgaaatcctgcgggattctccgtggcggcgcatcatcggcgatgacttcatcgaccacgcgttccgtttcgcccgtgaggccgatccgaaagccgaactctactacaacgactacggtctcgagaacgaaaggaagcggagcaactgcatcaagctcgtcaagggcatgaaacaacgcggcgtgccgatcgacggggtgggcacccagtcgcatttccacttgaaacatccctcgctccaggaaatcgaaaagaccatcaaggacttttccgaactcggactcaaggtgatgatcaccgagctggatgtcgatgtgctgccgtcgcgtggcaatttcggcaacgccgacatcagccgccgcgagcagggcggtgacgcactcaatccttacaccggcggcttgcccgatgaggtccaacaggaacttgcgaaacgctatgcggacatttttgatatctatctgcgccaccggaaggcggtcacccgcgtaaccttctggggactcgatgacgggcatacctggttgaacggtttcccgatccgcggacgcaccaactatccgctgttgttcgaccgcgccctcaagccgaagcccgcgttcgaggcggtcatcaaaaaagggcttgaacccaggaaacgttga

SEQ ID NO: 248 - protein, 347 aa, Unknown
  Obtained from an environmental sample
VFANDFLIGVALNSRQVAGESEAGKLAGAQFSSVTAENEMKWQSLHPQPDRYQFGAADSYIDFAKKHKMAVIGHTLVWHSQTPGWVFEGKDGKPATREDLLKRMRDHIHTVAGRYKGKVRGWDVVNEALSDGGPEILRDSPWRRIIGDDFIDHAFRFAREADPKAELYYNDYGLENERKRSNCIKLVKGMKQRGVPIDGVGTQSHFHLKHPSLQEIEKTIKDFSELGLKVMITELDVDVLPSRGNFGNADISRREQGGDALNPYTGGLPDEVQQELAKRYADIFDIYLRHRKAVTRVTFWGLDDGHTWLNGFPIRGRTNYPLLFDRALKPKPAFEAVIKKGLEPRKR

SEQ ID NO: 249 - DNA, 1439 bp, Unknown
  Obtained from an environmental sample
tgatcaatccagtgaaggatcttcgtgaagatttcatctttggaatggacgtttcaatgctctacgagatagagcggctcggtggtaagttcttcgatggtggtgtggagaaagatcttttccagatactgaaggatcatgagataaactggatcagattgagagtgtggaacgatccaagggatgaaaacggaaatccgctcggtgggggaaactgtgattatctgaaaatgacagagatcgcaaaaagggccaaaaagtacggaatgaaggttcttcttgactttcactacagcgactggtgggcagatcccggcaagcagtacaaaccaaaagagtgggatcaccttcatggagaacttctggaaagggcggtgtattcctacacgaaactcgtgctgaatcatatgagaagaaacggtgcactgccggacatggtccaggtgggaaacgaggtgaacaacggctttctctggccggatggaatgattgccggaaaggatgcaggaggattcgacggattcacaaaacttttgaaggcggccatcaaagccgtcagggaagttgatcccgatatcaagatagtcattcatttggcagaaggtggaaacaactcacttttcaggtggttcttcgacgagatcacaagaagagacgtggattttgatgtgatcggtgtatcgtactatccgtactggcatggtaccctggatgacctgaagaacaacctgtacgacatagcgaaaagatacaacaaagacgtgctcatcgttgaaacggcgtatgcctggacactcgaggacggggacggttaccccaacatcttcagtggtgaagagatggagctcacgggtggttacaaagcaacggttcagggacaggcaacgttcttgagggatctcatagaagtggtgaacagtgttcctgacggtcacggtcttgggatcttctattgggaaggagactggattcctgtgaaaggagccggctggaaaaccggcgaaggaaatccatgggagaatcaggccatgtttgatttcaatggaaatgctctcccatccctggatgttttcaagctcgtgaggacagtcactcctatggaaataaaaatcgaagagattctgcctgtggagatctcgacgaatttgggagagattccgaagtttccggatgctgtgaaagtgctgttcagcgatgattccatcagatccctgaaagttacatggaattttgatccttctcttgttgaaacacccggtgtctacagagtggaaggatacgtggaaagtatagaccagaagatcttcgcaaccttgactgtgaagggaagtagaaactacctgaagaaccctgggtttgaaacgggtgagttttctccctggaaggtgttcggtaacggaaaacgcagtgaaggtggtaaaggccgatcctccgagtaa

SEQ ID NO: 250 - protein, 479 aa, Unknown
  Obtained from an environmental sample
  SIGNAL (1)...(33)
MINPVKDLREDFIFGMDVSMLYEIERLGGKFFDGGVEKDLFQILKDHEINWIRLRVWNDPRDENGNPLGGGNCDYLKMTEIAKRAKKYGMKVLLDFHYSDWWADPGKQYKPKEWDHLHGELLERAVYSYTKLVLNHMRRNGALPDMVQVGNEVNNGFLWPDGMIAGKDAGGFDGFTKLLKAAIKAVREVDPDIKIVIHLAEGGNNSLFRWFFDEITRRDVDFDVIGVSYYPYWHGTLDDLKNNLYDIAKRYNKDVLIVETAYAWTLEDGDGYPNIFSGEEMELTGGYKATVQGQATFLRDLIEVVNSVPDGHGLGIFYWEGDWIPVKGAGWKTGEGNPWENQAMFDFNGNALPSLDVFKLVRTVTPMEIKIEEILPVEISTNLGEIPKFPDAVKVLFSDDSIRSLKVTWNFDPSLVETPGVYRVEGYVESIDQKIFATLTVKGSRNYLKNPGFETGEFSPWKVFGNGKRSEGGKGRSSE

SEQ ID NO: 251 - DNA, 555 bp, Unknown
  Obtained from an environmental sample
atggctacggattattggcaatattggacggatggcggcggaacggtgaatgcggttaacgggtccgggggcaattacagcgtaacttggcaaaatagcggggacttcgtggtcggcaaaggctggagcgtagggtcgccaaatcggacgatcaattacaatgccggcatctgggaaccttcggggaacgggtacttgaccctttacggatggactagaaactcgctgatcgagtattacgttgtcgacagttgggggacgtaccggccaacaggtactcacaaaggaacggtgaacagcgacggaggcacctacgatatttatacgaccatgcgctataatgcgccttccattgatggcacgcagacgttccaacagttctggagcgtgcggcaatcgaaacgaccaaccggcagcaacgtctccatcaccttcagcaatcacgtgaatgcctggagaagcaagggcatgaacctgggcagcagctggtcgtaccaggtcttggcgacggaaggctatcagagcagcggaagatccaacgtcacggtgtggtaa

SEQ ID NO: 252 - protein, 184 aa, Unknown
  Obtained from an environmental sample
MATDYWQYWTDGGGTVNAVNGSGGNYSVTWQNSGDFVVGKGWSVGSPNRTINYNAGIWEPSGNGYLTLYGWTRNSLIEYYVVDSWGTYRPTGTHKGTVNSDGGTYDIYTTMRYNAPSIDGTQTFQQFWSVRQSKRPTGSNVSITFSNHVNAWRSKGMNLGSSWSYQVLATEGYQSSGRSNVTVW

SEQ ID NO: 253 - DNA, 1047 bp, Unknown
  Obtained from an environmental sample
atgattgttagcttcaagagcctgaaggcactcgcgtgcctcggcgtgctcggcatcaccgccgcgcacgcgcaaacctgcatcacgtcgagccagacgggcaccaacaacggcaattacttttcgttctggaaagacagtccgggcacggtgaacttctgcatgtatgcgaatggccgctatacctccaactggagcggcatcaacaactgggtgggcggcaagggctgggctaccggctccagccacacgatcagctactccggcacgttcaattcgccgggcaacggttacctggccctgtatggctggaccaccaatccattggtcgagtactacatcgtcgacagctggggtacctaccgtccgccgggcggccagggtttcatgggcacggtagttagcgacgggggcacgtacgacgtgtaccggacgcaacgcgtgaaccagccatccatcatcggcaacgccacgttctaccagtactggagcgtgcggcagtcgaagcgcgtgggcggcaccatcaccatcgccaaccatttcaacgcctgggccacgctgggcatgaacctgggccagcacaactaccaggtcatggccaccgagggttaccagagcagcggcagctccgacatcaccgtgaccgaaggtggcggcagytcctcgtcgtcctcgggcggcggcagcaccagcagcagtggtggcggcggcaacaagagcttcacggtgcgtgcgcgcggcacggccggaggcgagaacatccagctgcaggtgaacaaccagacggtcgcgagctggaacctcaccaccagcatgcagaactacaccgcctcgaccagcctgagcggcggcatcaccgtgctctacaccaacgacggcggcagccgcgacgtgcaggtggactacatcatcgtgaacggccagacccgccagtccgaagcgcagagctacaacaccgggttgtatgcgaatggacgctgcggcggtggctcgaacagcgagtggatgcattgcaacggcgcgatcggctacggcaatacgccctga

SEQ ID NO: 254 - protein, 347 aa, Unknown
  Obtained from an environmental sample
  SIGNAL (1)...(24)
MIVSFKSLKALACLGVLGITAAHAQTCITSSQTGTNNGNYFSFWKDSPGTVNFCMYANGRYTSNWSGINNWVGGKGWATGSSHTISYSGTFNSPGNGYLALYGWTTNPLVEYYIVDSWGTYRPPGGQGFMGTVVSDGGTYDVYRTQRVNQPSIIGNATFYQYWSVRQSKRVGGTITIANHFNAWATLGMNLGQHNYQVMATEGYQSSGSSDITVTEGGGSSSSSGGGSTSSSGGGGNKSFTVRARGTAGGENIQLQVNNQTVASWNLTTSMQNYTASTSLSGGITVLYTNDGGSRDVQVDYIIVNGQTRQSEAQSYNTGLYANGRCGGGSNSEWMHCNGAIGYGNTP

SEQ ID NO: 255 - DNA, 1137 bp, Unknown
  Obtained from an environmental sample
ttgatcttttccgtcagtggttccgcgtctcggcggcgccctggcatccacaagggggattccatgattttcggtctaaagtcgatcacgggcaggcgcgccgtcgcggcgctggcctgccttgccggcctctacatggcgccggcgaatgcgcaaacctgcatcacgtcgagccagacgggcaccaacaacggcaactacttttcgttctggaaagacagcccgggcacggtgaacttctgcatgtactccggcggccgctacacgtccaactggagcggcatcaacaactgggtgggcggcaagggctggcagacgggctcgtcccgcaccgtctcctactccggcagcttcaattcgccgggtaacggctacctgacgctctacggctggaccaccaatccgctcatcgagtactacatcgtcgacaactggggcagctatcgtccgccgggtggccagggcttcatgggcacggtgaacaccgacggcggcacgtacgacatctatcgcacgcaacgggtcaaccagccgtcgatcatcggcaccgcgacgttctaccagtactggagcgtgcggcagtcgaagcgcaccggcggcaccatcaccacggccaaccacttcaatgcctgggccagcctcggcatgaacctgggacagcacaactaccaggtgatggccaccgagggctaccagagcagcggcagctccgacatcacggtgtgggaaggcacgagcagcggcggaagcagcaatggcggcagcagcaacggcggcagcagcaatggtggcagcggcggcacgaagagcttcacggtgcgcgcgcgcggcactgcgggcggcgagtccatcacgctgcgggtcaacaaccagaacgtgcagacctggacgctgggtaccagcatgcagaactacacggcctcgacctcgctgagcggcggcatcacggtggcgttcaccaacgacggcggcagccgcgacgtgcaggtggactacatcatcgtgaatggccagacccgccagtccgaacagcagagctacaacactggcctctacgccaatggaagctgtggtggcggttcgaacagcgagtggatgcattgcaacggcgccatcggctacggcaatacgccctga

SEQ ID NO: 256 - protein, 378 aa, Unknown
  Obtained from an environmental sample
  SIGNAL (1)...(51)
LIFSVSGSASRRRPGIHKGDSMIFGLKSITGRRAVAALACLAGLYMAPANAQTCITSSQTGTNNGNYFSFWKDSPGTVNFCMYSGGRYTSNWSGINNWVGGKGWQTGSSRTVSYSGSFNSPGNGYLTLYGWTTNPLIEYYIVDNWGSYRPPGGQGFMGTVNTDGGTYDIYRTQRVNQPSIIGTATFYQYWSVRQSKRTGGTITTANHFNAWASLGMNLGQHNYQVMATEGYQSSGSSDITVWEGTSSGGSSNGGSSNGGSSNGGSGGTKSFTVRARGTAGGESITLRVNNQNVQTWTLGTSMQNYTASTSLSGGITVAFTNDGGSRDVQVDYIIVNGQTRQSEQQSYNTGLYANGSCGGGSNSEWMHCNGAIGYGNTP

SEQ ID NO: 257 - DNA, 2694 bp, Unknown
  Obtained from an environmental sample
atggctgatatatctaccacaccagtcacagcctcgacagatgctgccaagaacctgtatgcctatttcctggaccagtatggcaagaagacgatttccagcgtcatggccaatgtcaactggaacaacacttgtgccgagaaagtctataaactcacgggcaagtatcctgccatgaactgctacgacttcatccacatctgtttctcgccagccaactggattgactacaccgacatcactcctgccaaggaatggcacgatgcgggcggtatcgtacagttgatgtggcatttcaatgtgcctaagagccagggggcaacagatgttacctgcacgcccagcgagaccacctttaaggcttccaatgctctggttagcggcacgtgggagaacaaatggttctacgagcagatggacaaggtcattgccaccatcctcaagttacaggacgctggcattgccgctacctggcgacctttccatgaggcagcaggcaatgcttgcgccaagcagcaggccgactggaccaaagcatggttctggtggggctacgacggtgccgacacctacaagaaactgtggattgccatgtacgactatttcaagctgaaaggcgtgaacaacctcatctggatgtggaccacccagaattataatggtgacagcagcaaatacaaccaggacaccgactggtaccctggcgacgagtatgttgacatcgtggcccgcgacctctatggctacaatgccgaccagaacctgcaggagttcagcgagattcaggctgcctatcccaacaagatggtggttctgggtgaatgcggaaaaggtgatagcggcgaccccggcaagatgtccgatgtatgggcgaaaggtgccaagtggggccacttcatggtatggtatcaaggcgaacaaggctctaccgacacgatgtgcagcgacgactggtggaaggatgccatgagcagcgccaacgtcatcacccgcgacaaggtggttatccccgatgtcacttcaaccatcgagaatgccacggatgccgtgaagaacatgggactggggtggaacctggggaacgccctcgacgccaatgcccagcaataccatgatgccacccaggacaactactggggacagcaggacattacctctgagagctgctggggtcagctacccaccaaggcagagctgatggccatgatgaaagaagccggtttcggagccatccgcgttcccgtgacatggtataaccacatggacaaggacggcaatgtggatgcagcatggatgaatcgtgtgcatgaggtggttgactatgtcatcagccagggaatgtactgcatcctcaacgtacaccacgacacgggtgccgacagctacgacagccagaagaacctcaccggctaccattggatcaaggccgacgaaaccaactacgccaccaacaaggcccgctatgagaagctgtggcagcagatagcccaggagttccgcaactacggccagctgctgctgttcgagggctataacgagatgctcgatgccaacaactcctggaattttgcacagagcagttcagcctacgatgccatcaacaaatacgcccagagctttgtcgatgtcgtacgcgccaccggtggcaacaatgcccagcgcaacctcattgtcagcacatacggcgcctgctcaggcaacggcacgtgggatgcaagagtgcaagaccccttgaagaaactgcagattcccacgggtgaaagcaaccatatcatcttcgaggttcacaactatccctccatcgtcaacaaggacaacgcgggcaactacgtcagcgatcgcaccatcagcgaaatcaaggcagagattgatgcatggcttaagaacttaaagacccacctcgtcagcaagggcgctcccgtcatcatcggcgaatggggcaccaacaacgtcgatgccggcggtggcaagacagactacgacctccataaggacctgatgttcgaatttgtcagctacatgataaagaccatgaagcagaacgacattgccaccttctactggatgggacttaccgacggcgctccacgcacctaccccgccttcacacagcccgacctggcgctgaagatgctgcaggcctatcacggcgactcttggaatccctacctgcctgacgccaaggactttcccgaaggcaaaatcacctcggccacggtgaatttcaacagccaatggggcgaactgaccatccacgatggagctattgacaagaccgtctatagaggtatcaaggtggagctggaagaaaagcctgccactggagccctgtctttcaaggtatatgccaacagtgagaaggcaacagccatcaattccaaaaccccacagttggctttcttcagttacacaggcatccagaaaatcaacctacagtggaacatagccaccaaggggagtatcaaaatcaagagcgtcaaccttatcaagcacgacgactccacagaaccctgtagtctgaaagtggcttggggttgtactctcagcgaccagaactacgccacgggcatcgaagacattactatcactcctgttcgtcatgacgatggaatcatctacaatctgagcggacagcctgtaacctctcctcagcgcggcatctacatcctcaacggaaagaaaatcatcaaatag

SEQ ID NO: 258 - protein, 897 aa, Unknown
  Obtained from an environmental sample
MADISTTPVTASTDAAKNLYAYFLDQYGKKTISSVMANVNWNNTCAEKVYKLTGKYPAMNCYDFIHICFSPANWIDYTDITPAKEWHDAGGIVQLMWHFNVPKSQGATDVTCTPSETTFKASNALVSGTWENKWFYEQMDKVIATILKLQDAGIAATWRPFHEAAGNACAKQQADWTKAWFWWGYDGADTYKKLWIAMYDYFKLKGVNNLIWMWTTQNYNGDSSKYNQDTDWYPGDEYVDIVARDLYGYNADQNLQEFSEIQAAYPNKMVVLGECGKGDSGDPGKMSDVWAKGAKWGHFMVWYQGEQGSTDTMCSDDWWKDAMSSANVITRDKVVIPDVTSTIENATDAVKNMGLGWNLGNALDANAQQYHDATQDNYWGQQDITSESCWGQLPTKAELMAMMKEAGFGAIRVPVTWYNHMDKDGNVDAAWMNRVHEVVDYVISQGMYCILNVHHDTGADSYDSQKNLTGYHWIKADETNYATNKARYEKLWQQIAQEFRNYGQLLLFEGYNEMLDANNSWNFAQSSSAYDAINKYAQSFVDVVRATGGNNAQRNLIVSTYGACSGNGTWDARVQDPLKKLQIPTGESNHIIFEVHNYPSIVNKDNAGNYVSDRTISEIKAEIDAWLKNLKTHLVSKGAPVIIGEWGTNNVDAGGGKTDYDLHKDLMFEFVSYMIKTMKQNDIATFYWMGLTDGAPRTYPAFTQPDLALKMLQAYHGDSWNPYLPDAKDFPEGKITSATVNFNSQWGELTIHDGAIDKTVYRGIKVELEEKPATGALSFKVYANSEKATAINSKTPQLAFFSYTGIQKINLQWNIATKGSIKIKSVNLIKHDDSTEPCSLKVAWGCTLSDQNYATGIEDITITPVRHDDGIIYNLSGQPVTSPQRGIYILNGKKIIK

SEQ ID NO: 259 - DNA, 1143 bp, Unknown
  Obtained from an environmental sample.
atgaagaaaattcgcttactccagggtgtttcgttggccatgtcaataatgtttcttttgtcatgtcaggcacaaaaaccagttgactctcttaaggaagcatttgatggtttgtttcttataggtactgccatgaacacccctcagatcaccggccaggatacacaaacacttgagttgataaaaaaacacatgaactccatagtggccgaaaatgtaatgaaaagtgaggtgcttcaacccagggaaggagagtttgattttactcttgccgatcagtttgttcaatttggtatcgataacaatatgcatatagttggccatacccttatatggcattcccaggcgccacgatggttttttgtggatgagaacggaaacgatgtgagccccgaaattctgaaacaaagaatgaaagaccatatttataccgtagtaggccgttataaaggcaaaattcatggatgggatgtggtgaatgagtgtataaatgacgatggttcgtggcgcaatagtaagttttaccaaattcttggtgaagattttgttaaatatgcattccagtttgcagctgaagccgatcccgatgcagagctttattacaatgattattcgatgttccttccaggacgtagggaaggcgtaattaagatggtgagaaatctgcaggaacagggaattaaaattgatggtattgggatgcagggccacctgatgattgattatccacccctcgaagattttgaaacgagtatactggcttttgccgatctgggggtgaatgtcatgataaccgaactcgatatatccgttttgccatttcctacccgcaacgtgggcgccgatgtttctctgaacattgcatacaatactgaattaaatccctacccgaatggcttacccgaagatgtagcgcagaaattacataatcggtgggtggatctttttcgcctgttcattaaacaccacgataaaattacccgtgtaaccacttggggtacagccgatgccatgtcatggaagaataactggcccattcgtggacgtacagattatcccttacttttcgatcgcgattttcagcccaaaccctttgtcgctgatataattaaggaggcattggcagccaaaagaaaattataa

SEQ ID NO: 260 - protein, 380 aa, Unknown
  Obtained from an environmental sample.
  SIGNAL (1)...(24)
MKKIRLLQGVSLAMSIMFLLSCQAQKPVDSLKEAFDGLFLIGTAMNTPQITGQDTQTLELIKKHMNSIVAENVMKSEVLQPREGEFDFTLADQFVQFGIDNNMHIVGHTLIWHSQAPRWFFVDENGNDVSPEILKQRMKDHIYTVVGRYKGKIHGWDVVNECINDDGSWRNSKFYQILGEDFVKYAFQFAAEADPDAELYYNDYSMFLPGRREGVIKMVRNLQEQGIKIDGIGMQGHLMIDYPPLEDFETSILAFADLGVNVMITELDISVLPFPTRNVGADVSLNIAYNTELNPYPNGLPEDVAQKLHNRWVDLFRLFIKHHDKITRVTTWGTADAMSWKNNWPIRGRTDYPLLFDRDFQPKPFVADIIKEALAAKRKL

SEQ ID NO: 261 - DNA, 1629 bp, Unknown
  Obtained from an environmental sample.
atgataaacaaaattggcaaaggttttttttctgcgttcatttgtgctgctgcgttgagtgtctccacagttaatgctcagcaaactgtcaccaccaacacgcaaggcacgcacgatggttttttctattcgttttggaaagacagtggtgatgcatcatttggtttgcgtgagggagggcgttacacctcgcaatggaatacttctaccaataactgggtgggtggaaaagggtggaatcccggtggtagaagggttgttcactatcaaggccaatataatgttgataattcacaaaactcttatttggcattgtatggctggacacgctcaccactgattgaatattacgtgattgaaagttacggctcgtataacccgtcgaattgcacccaaggtcggcagacctatggcacctttcagagtgatggtgcaacctatgaaattgttcgctgtcagcgagttcagcagccctctatcgatggcacacaaactttctatcaatacttcagtgtgcgtcagccgaagaaaggctttggtagtatcagtggtacgatcactgtgggcaaccattttgatgcatgggccgccgccggtttgaacctgggggaacatgattatatggtgatggctaccgagggttatcagagcaccggtagttcggatattacggtcagtgaaattaccggtggttcaggtggtggctcttcctcgggtgctaataccctggtgattcgtgctgtgggcacctctggtaatgaattgctgcgtgtcaatgtgggtggtagccctgtgcagacattgagcctttcgaccagttggcaggattttactgtcaatacggatgcaacgggtgacattaacgtagagttgtttaatgatcagggtcagggttatgaggcgcgtatcgattatgtgctggttaatggtgagacccgctacgcggccgatcagagttataacaccagtgcctgggacggcgaatgtgggggtggctcttttacccagtggatgcattgtgatggcatgattggctttggtgatatgaccggcggcaatgccggtggtggcggttcttcgggtggttctggcgccaatactctggtggtgcgtgctgtcggcacttcaggtaacgagcagttgcgcgtgaatgtgggcggcaacacgattcaaacactgaacctgtcaagcagttggcaagattttactgtcaataccgatgcctcgggcgatattaacgtagagctgtttaatgaccagggtcagggctatgaggcgcgtattgattatgtgctggttaatggcgagacccgctacgcggctgaccagagttataacaccagcgcctgggatggcgaatgcgggggtggctcttttacccaatggatgcattgtgatggcatgattggttttggtgatatgtcgggtggtggttctgctgtgggtacaagcagtagcggtaatgccggcagcaataccagcagtgcctgttactgtaattggtatggcagtgtgatggcttcttgtgaaaatcaggtgaacggctggggttgggaaaataatcaaagctgtattggtaataatacctgtaataatcagggcggtagcggaggcgtggtgtgcaattaa

SEQ ID NO: 262 - protein, 542 aa, Unknown
  Obtained from an environmental sample.
  SIGNAL (1)...(26)
MINKIGKGFFSAFICAAALSVSTVNAQQTVTTNTQGTHDGFFYSFWKDSGDASFGLREGGRYTSQWNTSTNNWVGGKGWNPGGRRVVHYQGQYNVDNSQNSYLALYGWTRSPLIEYYVIESYGSYNPSNCTQGRQTYGTFQSDGATYEIVRCQRVQQPSIDGTQTFYQYFSVRQPKKGFGSISGTITVGNHFDAWAAAGLNLGEHDYMVMATEGYQSTGSSDITVSEITGGSGGGSSSGANTLVIRAVGTSGNELLRVNVGGSPVQTLSLSTSWQDFTVNTDATGDINVELFNDQGQGYEARIDYVLVNGETRYAADQSYNTSAWDGECGGGSFTQWMHCDGMIGFGDMTGGNAGGGGSSGGSGANTLVVRAVGTSGNEQLRVNVGGNTIQTLNLSSSWQDFTVNTDASGDINVELFNDQGQGYEARIDYVLVNGETRYAADQSYNTSAWDGECGGGSFTQWMHCDGMIGFGDMSGGGSAVGTSSSGNAGSNTSSACYCNWYGSVMASCENQVNGWGWENNQSCIGNNTCNNQGGSGGVVCN

SEQ ID NO: 263 - DNA, 1092 bp, Unknown
  Obtained from an environmental sample.
atgaaaactaatcacccatttaaattcgggaaaaaaatatgtatggcattggctttgctggtgcttggcatacaggcttcaatcgcacaggaaatttgtattaccagcggcactgaccagatcagagaaaccacatccaacggctatacccacgaactatggaatcaggacacccgggggacggcctgtatgactattaatgcaggcaccacttacagtgcgcggtggaacggtgcatttaactatttggcccgccgtggattggcctacgatggttcgtccctcacccatgctgaccgggggaaattcaccataaattatgcctctaactacaactgcaacaatatgaatgggctctcttatttaagcgtgtacggatggacgcgggattttgccaaggaaaatgccaatccggcaggatcacaggctcatcaggaagcgctggtggaatattacattgttgaaaactggtgcgactggaatgtttcacaagaccctaacgcccagagtctgggcaccctgaatgttgatgggtcgatctatgatatgtatcgcacagaacggatcaaccaaccttctatcaggtgcggtggtacctgcgataatttttaccaatacttcagcattcgccgcaacacacgtaacagtggcaccattgatgtcagcgctcatttcaaccagtgggaagcattaaccggcgtccctatgggtggcctgcacgaagtgatgatgaaggtcgaaggctacaactcaaacaatcaatccagtggcaatgtaagctttactcaattgctcatgcgtgcccgcttcgaggatggcgccattgtcgagaaccagaatgcggtcggccatgcgcacggtggagaagcggtgggagatgatcaccgccgtcttgccctgggccaggcccttgaagcgggcgaacacctcggcctcggccttggcgtcgagggcggcggtgggttcgtcgagaatgatcaactcggcgtcgcgcatataggcgcgggcgatggctaccttctgccactcgccgcccgagaggtcgcggccctgcttgaaaaggcgccccaattgctccagagaaacgggtga

SEQ ID NO: 264 - protein, 363 aa, Unknown
  Obtained from an environmental sample.
  SIGNAL (1)...(29)
MKTNHPFKFGKKICMALALLVLGIQASIAQEICITSGTDQIRETTSNGYTHELWNQDTRGTACMTINAGTTYSARWNGAFNYLARRGLAYDGSSLTHADRGKFTINYASNYNCNNMNGLSYLSVYGWTRDFAKENANPAGSQAHQEALVEYYIVENWCDWNVSQDPNAQSLGTLNVDGSIYDMYRTERINQPSIRCGGTCDNFYQYFSIRRNTRNSGTIDVSAHFNQWEALTGVPMGGLHEVMMKVEGYNSNNQSSGNVSFTQLLMRARFEDGAIVENQNAVGHAHGGEAVGDDHRRLALGQALEAGEHLGLGLGVEGGGGFVENDQLGVAHIGAGDGYLLPLAAREVAALLEKAPQLLQRNG

SEQ ID NO: 265 - DNA, 996 bp, Unknown; identical to SEQ ID NO: 49
  Obtained from an environmental sample.

SEQ ID NO: 266 - protein, 331 aa, Unknown; identical to SEQ ID NO: 50
  Obtained from an environmental sample.

SEQ ID NO: 267 - DNA, 1956 bp, Bacteria
atgaagcgtaaggttaagaagatggcagctatggcaacgagtataattatggctatcatgatcatcctacatagtataccagtactcgccgggcgaataatttacgacaatgagacaggcacacatggaggctacgactatgagctctggaaagactacggaaatacgattatggaacttaacgacggtggtacttttagttgtcaatggagtaatatcggtaatgcactatttagaaaagggagaaaatttaattccgacaaaacctatcaagaattaggagatatagtagttgaatatggctgtgattacaatccaaacggaaattcctatttgtgtgtttacggttggacaagaaatccactggttgaatattacattgtagaaagctggggcagctggcgtccacctggagcaacacccaaaggaaccatcacagtggatggcggtacttatgaaatatatgaaactacccgggtaaatcagccttccatcgatggaactgcgacattccaacaatattggagtgttcgtacatccaagagaacaagcggaacaatatctgtcactgaacattttaaacagtgggaaagaatgggcatgcgaatgggtaagatgtatgaagttgctcttaccgttgaaggttatcagagcagtgggtacgctaatgtatataagaatgaaatcagaataggtgcaaatccaactcctgccccatctcaaagcccaattagaagagatgcattttcaataatcgaagcggaagaatataacagcacaaattcctccactttacaagtgattggaacgccaaataatggcagaggaattggttatattgaaaatggtaataccgtaacttacagcaatatagattttggtagtggtgcaacagggttctctgcaactgttgcaacggaggttaatacctcaattcaaatccgttctgacagtcctatcggaactctacttggtaccttatatgtaagttctaccggcagctggaatacatatcaaaccgtatctacaaacatcagcaaaattaccggcgttcatgatattgtattggtattctcaggtccagtcaatgtggacaacttcatatttagcagaagttcaccagtgcctgcacctggtgataacacaagagacgcatattctatcattcaggccgaggattatgacagcagttatggccccaaccttcaaatctttagcttaccaggcggtggcagcgccattggctatattgaaaatggttattccactacctataataacgttaatttcgccaacggcttaagttctataacagcaagagttgccactcagatctcaacttccattcaggtgagagcaggaggagcaaccggtactttacttggtacaatatatgttccttcgacaaatagttgggattcttatcagaatgtaactgccaaccttagcaatattacaggtgtgcatgatattacccttgtcttttcaggaccagtgaatgtggactacttcgtatttacaccagcaaatgtaaattcagggcctacctcccctgtcggaggtacaagaagtgcattttccaatattcaagccgaagattatgacagcagttatggtcccaaccttcaaatctttagcttaccaggtggtggcagcgccattggctatattgaaaatggttattccactacctataaaaatattgattttggtgacggcgcaacgtccgtaacagcaagagtagctacccagaatgctactaccattcaggtaagattgggaagtccatcgggtacattacttggaacaatttacgtggggtccacaggaagctttgatacttatagggatgtatccgctaccattagtaatactgcgggtgtaaaagatattgttcttgtattttcaggtcctgttaatgttgactggtttgtattctcaaaatcaggaacttaa

SEQ ID NO: 268 - protein, 651 aa, Bacteria
  SIGNAL (1)...(30)
MKRKVKKMAAMATSIIMAIMIILHSIPVLAGRIIYDNETGTHGGYDYELWKDYGNTIMELNDGGTFSCQWSNIGNALFRKGRKFNSDKTYQELGDIVVEYGCDYNPNGNSYLCVYGWTRNPLVEYYIVESWGSWRPPGATPKGTITVDGGTYEIYETTRVNQPSIDGTATFQQYWSVRTSKRTSGTISVTEHFKQWERMGMRMGKMYEVALTVEGYQSSGYANVYKNEIRIGANPTPAPSQSPIRRDAFSIIEAEEYNSTNSSTLQVIGTPNNGRGIGYIENGNTVTYSNIDFGSGATGFSATVATEVNTSIQIRSDSPIGTLLGTLYVSSTGSWNTYQTVSTNISKITGVHDIVLVFSGPVNVDNFIFSRSSPVPAPGDNTRDAYSIIQAEDYDSSYGPNLQIFSLPGGGSAIGYIENGYSTTYNNVNFANGLSSITARVATQISTSIQVRAGGATGTLLGTIYVPSTNSWDSYQNVTANLSNITGVHDITLVFSGPVNVDYFVFTPANVNSGPTSPVGGTRSAFSNIQAEDYDSSYGPNLQIFSLPGGGSAIGYIENGYSTTYKNIDFGDGATSVTARVATQNATTIQVRLGSPSGTLLGTIYVGSTGSFDTYRDVSATISNTAGVKDIVLVFSGPVNVDWFVFSKSGT

SEQ ID NO: 269 - DNA, 1110 bp, Unknown
  Obtained from an environmental sample.
atggggtacaataggatcatacaagcgatccgcgtaagcaagggagatgttttgggcgttcataaagttttttacgctgcacttgcgtgtgtggcgatggggtattcggaaacgtgggcacagtgcgcgacctggacccgaagcaccattcgcaattgcgagggcatcgactacgagttgtggaaccagaacaaccgcggcacggtcaacatggaaatcacgggaaacggaacgttcgcggcgacgtggagcggaacggaaaacatcctgtttcgcgccggcaagaaatgggggttcaacagcaccacgacggcgcggtcggtcggcgccatcacgctcgatttcgctgcgacctggacctccagcgacaacgtgaaaatgctcggcatctacggctgggcgtattacccgtcgggaagcgagccgacgaaaacggaaagcggtcaaaacacgagcttttccgatcagatcgagtattacatcatccaggaccgcggaggcttcaacccgggttccggcggcgtcaacgccaaaaagtacggcgaggccgtgatcgacggaatcgcctatgacttttgggtggccgaccggatcaaccagcccatgctgacaggaagaggcaacttcaagcaatacttcagcgttccacggaacacgagcagccaccggcaaagcggcatcgtcagcatttcgaagcactttgaggagtgggacaaggccggcatgaagatgctggactgtccgctatacgaagtcgcgatgaaggtggaatcgtatacgggctcggcgaatggcggcgggtcggcgaacgtgacccggaatattctcacgctcggcggttcttccgcaccgacccctatcgcgcgcggccccggccggtccgccgaaagcatgcgggtcgccttcgttcaggaaagagtgctcaaggtcgcgcccgtcgacggaacccgcctgcaagtcaaggtgcgggacgtgaagggcgtgaaccgggccgagttcaatgccgcgggcgcggcaacgttctcgttgtcccatgtccccgcgggcccgtatttcctggatgtgacggggccggatgtaagacagatcacgccgttcgttttgcgataa

SEQ ID NO: 270 - protein, 369 aa, Unknown
  Obtained from an environmental sample.
MGYNRIIQAIRVSKGDVLGVHKVFYAALACVAMGYSETWAQCATWTRSTIRNCEGIDYELWNQNNRGTVNMEITGNGTFAATWSGTENILFRAGKKWGFNSTTTARSVGAITLDFAATWTSSDNVKMLGIYGWAYYPSGSEPTKTESGQNTSFSDQIEYYIIQDRGGFNPGSGGVNAKKYGEAVIDGIAYDFWVADRINQPMLTGRGNFKQYFSVPRNTSSHRQSGIVSISKHFEEWDKAGMKMLDCPLYEVAMKVESYTGSANGGGSANVTRNILTLGGSSAPTPIARGPGRSAESMRVAFVQERVLKVAPVDGTRLQVKVRDVKGVNRAEFNAAGAATFSLSHVPAGPYFLDVTGPDVRQITPFVLR

SEQ ID NO: 271 - DNA, 1128 bp, Unknown
  Obtained from an environmental sample.
atgttcattcacaacagcatatgcagcgcactctgcacaatctttttggcaactgcaacaatgggagaaaacatgacactacaagaagcctttgccgatcacttttatgtgggagccgccatcagccaacgcctttttcaaccagatcgcgccgaaacgctgcaactggccgcgcaccaattcaacagcatcacagccgaaaatgagatgaagtggcagtcgttaaatcccactcctggcgaataccgtttcgaaaacgccgataaattcgtccgctttggtgtcgaaaacgatatgtacatcgttgggcacgttctcttctggcacagccagacacccgactggctcttcaaggatgacgacggtaacttcgtctcccgcgaagtcttactcgaccgcatgcgcgcccacgtgcgcaatcttgtccagcgctacggcaaccatgtgcacgcctgggatgttatcaatgaaaccttcaatgataatggttccttgcgcgacagcccatggacgcaaatcctcggcgaggaattcatcgagcacgccttccggattgccggcgaggaactccccccccatgtcgagctgctctacaatgattattcgatgaccattcctgccaagcgcgatgctgttgctgaaatggttcgcgacctcatagccaaaggcatccgcattgacggcgttggcatgcagggacattgggcacggacccacccgaccatagcggacatagaaaaaagcattcttgccttcgcaggaaccggcgtacaggtacacatcactgagctcgacatcgacatgctgccacgccatccccagatgtttactggtggtgcagacaccatgttgcgcctacaacaagatcccaaactcgacccctacactgagggacttccagcggaagatcagcaggcattggcagaacgctacgcaagcatcttccgtttattcttgaagcacagcgatgttattcgccgtgtcaccttctggggggtcaccgatgcccacacctggctcaacaattggcccatccgtggccgcaccagccatcccctgctcttcgaccgccagaacaaccccaaacccgccttccacgccgtcgtcagactgaagaccgaagactga

SEQ ID NO: 272 - protein, 375 aa, Unknown
  Obtained from an environmental sample.
  SIGNAL (1)...(22)
MFIHNSICSALCTIFLATATMGENMTLQEAFADHFYVGAAISQRLFQPDRAETLQLAAHQFNSITAENEMKWQSLNPTPGEYRFENADKFVRFGVENDMYIVGHVLFWHSQTPDWLFKDDDGNFVSREVLLDRMRAHVRNLVQRYGNHVHAWDVINETFNDNGSLRDSPWTQILGEEFIEHAFRIAGEELPPHVELLYNDYSMTIPAKRDAVAEMVRDLIAKGIRIDGVGMQGHWARTHPTIADIEKSILAFAGTGVQVHITELDIDMLPRHPQMFTGGADTMLRLQQDPKLDPYTEGLPAEDQQALAERYASIFRLFLKHSDVIRRVTFWGVTDAHTWLNNWPIRGRTSHPLLFDRQNNPKPAFHAVVRLKTED

SEQ ID NO: 273 - DNA, 1134 bp, Unknown
  Obtained from an environmental sample.
atggtttcatcgctaatcaattcttcatacattcggctcaagcactattcgtgctcaagtttattgctcctgacattggcagcctgtggcggccagcagcctcccccggatacgggatccagcacttcaagttcaagcagttcttcgagctccagttcaagcagctcttcaagttccagctcaagcagttcttccagctccagctcgagcagctcttcgagttcgagctcttcatcatccagctcttcaggggcaaacccgccaccgaccgggggcaagttcgtcggcaacatcacgacccgaggcgccgtccaagcggacttcattcagtactgggatcaaattacgccggagaacgagggcaaatggggttctgtggaaggaactcgcgaccagtacaactgggcgcctcttgatcgcatctatgactatgcacgtcagcacaatatcccagtcaaagcgcatacgctggtttggggtgcacaggctccaggctggatcaacaatctgagtgcggccgagcagcgtgaggaaatcgaggaatggattcgtgattactgcacgcgttacccagacacccaaatgatcgacgtagttaacgaggcgcacccaaatcacgcccccgctcgctatgcgcagaatgccttcggcaatgactggattaccgaagcgttcaaactggcgcgccggcactgccccaacgccattttgatctacaacgactataatttcatcacttgggataccgatgaaatcatggcgctgattcgcccggctatcgcagcaggggtagtggatgcggtagggctgcaggcgcatagcttgtatcctgacgaatacgctaacaagatgtggagtgccgctgaaatacagcagaagctcgatctgatctctacccttggcgtgccgatgtatatttcggaatatgatgtcgccaagtccaatgaccaagagcagttggcgattttcagcgagcagttcccggtcctttacgaacaccccaatgtcgtaggtgtaaccctctggggctatattgatggagcgacgtggcgcgccggctcgggcttgattcgaaacggtcagcaccggcccgccatgcaatggctgctcgagtacttggagaacaatcgatag

SEQ ID NO: 274 - protein, 377 aa, Unknown
  Obtained from an environmental sample.
  SIGNAL (1)...(74)
MVSSLINSSYIRLKHYSCSSLLLLTLAACGGQQPPPDTGSSTSSSSSSSSSSSSSSSSSSSSSSSSSSSSSSSSSSSSSSSSSGANPPPTGGKFVGNITTRGAVQADFIQYWDQITPENEGKWGSVEGTRDQYNWAPLDRIYDYARQHNIPVKAHTLVWGAQAPGWINNLSAAEQREEIEEWIRDYCTRYPDTQMIDVVNEAHPNHAPARYAQNAFGNDWITEAFKLARRHCPNAILIYNDYNFITWDTDEIMALIRPAIAAGVVDAVGLQAHSLYPDEYANKMWSAAEIQQKLDLISTLGVPMYISEYDVAKSNDQEQLAIFSEQFPVLYEHPNVVGVTLWGYIDGATWRAGSGLIRNGQHRPAMQWLLEYLENNR

SEQ ID NO: 275 - DNA, 1401 bp, Unknown
  Obtained from an environmental sample.
ttgggcgctgatccatttgcgctcacctataacggaagagtgtacatttatatgtcgagtgatgactatgaatatcacagcaatggaacgattaaggataattcttttgccaatttgaatagggtctttgtcatctcttcagcagatatggtgaactggacagatcatggcgcgattccagtagctggggcaaatggcgcaaatggcggcaaaggaattgccaaatgggcaggtgcttcctgggctccatcagcagcggtgaaaaaaatcaatgggaaggataaatttttcctttatttcgcgaacagcggcggagggattggcgttctgacagcagactcccccatcggtccatggacagatcctatcggaaaagcactcgtcacgccaaatacaccagggatggctggagttgtatggctttttgatcctgccgtttttgtagatgatgacggcactggttatctatatgccggcggaggtgttccaggcggttctaatccaacgcagggacaatgggcgaatcctaaaacagcaagagttctaaaactaggacctgatatgacaagtgtggtaggcagcgcatcaaccattgatgctccttttatgtttgaagattcggggatgcataagtataacggaacctattactattcctattgcatcaactttggcggctcccacccagcagataaaccacctggtgagatcggttatatgacgagctcaagtccgatgggtccctttacgtatagagggcacttcctgaaaaatccgggtgcatttttcgggggaggcggtaataaccatcatgctgtgttcaattttaaaaacgagtggtatgtcgtgtatcatacccaaacggtcagctctgctttatacggatcaggaaaaggctacagatctccgcatattaataaacttgtgcataatgctgacggctcccttcgagaagtcgcagccaattttgaaggggttaaacagctttccaacctgaatccttatcagcgtgtagaagctgaaacattcgcatggaatggacgcattttgacagaggcatcttcagctccaggcggaccggtcaataaccagcatgtcacaaacattcaaaacggagattgggtggctgccagtaacgtcgatttcggatcaaacggcgcgaggacatttaaagcgaatgtagcatcaaatacaggcgggaaaatagaagtacgcctcggaagtccagacggcagactcgtcggaacactgaatgtcccttccacagggggaacaaataactggcgagaagtagaaacggcagtaaatggagcagcaggcgtgcacaacgtattttttgtttttactggaacaggtgcaaatctatttcaatttgattcctggcagtttactcaaaggtaa

SEQ ID NO: 276 - protein, 466 aa, Unknown
  Obtained from an environmental sample.
MGADPFALTYNGRVYIYMSSDDYEYHSNGTIKDNSFANLNRVFVISSADMVNWTDHGAIPVAGANGANGGKGIAKWAGASWAPSAAVKKINGKDKFFLYFANSGGGIGVLTADSPIGPWTDPIGKALVTPNTPGMAGVVWLFDPAVFVDDDGTGYLYAGGGVPGGSNPTQGQWANPKTARVLKLGPDMTSVVGSASTIDAPFMFEDSGMHKYNGTYYYSYCINFGGSHPADKPPGEIGYMTSSSPMGPFTYRGHFLKNPGAFFGGGGNNHHAVFNFKNEWYVVYHTQTVSSALYGSGKGYRSPHINKLVHNADGSLREVAANFEGVKQLSNLNPYQRVEAETFAWNGRILTEASSAPGGPVNNQHVTNIQNGDWVAASNVDFGSNGARTFKANVASNTGGKIEVRLGSPDGRLVGTLNVPSTGGTNNWREVETAVNGAAGVHNVFFVFTGTGANLFQFDSWQFTQR

SEQ ID NO: 277 - DNA, 1128 bp, Unknown
  Obtained from an environmental sample.
atgcgaaacacattaatccttttgattccggccttgatgatgctttcttgcagtgcgggaaatcaggatagagtaccatccctgcacgccgagttctcggatgcatttttgattggaacggcgctgaattctgagcagatattgggtcgggatacacgcggactcgaattgattagaactcattttaacgccattacgcccgaaaacattaccaaatgggaggctatccatcccgaacccggtgtctatgattttaaagaggctgatgcattcgtcgattttggccaaaaatataatatgttcatggtgggtcatacactggtttggcatagtcagacaccgcgctgggtcttcaaagacgaaaatggcgcgttggtatcgcgcgaggtactgttagagcggatgcgcgaccacatccacaccgttgttggccgctaccgtggacgtattcacggctgggatgtcgtaaacgaagccctcaatgaagacggttcgtacagagaaacactgtggtaccaaataattggtacggactatattcttaaagcattcgaatttgcccgggaggccgatcccgacgctgagctatactataacgattactcgcttgagaacccctcaaagagagccggcgcgatgcgaattgttcaatacctgcaggaacatggtgctccgattactggggttggaacccaggggcatttcaccctcgactggcccgaactttctgaaattgaacagaccgtcattgattttgcctcccttggtatggatgtaatgattaccgaattggatatcgatgtactgcctcagccagacgattatactggcgccgatgtgaattttagcgcagagctttacgacgaactgaacccatggcccaacggccttccaccggaaattgaacaggaattggccaatcgatatgccgacatcttcgaaatctatttgcgtcatcgtgataaagttacgcgagtgtctttttggggtgtcacagatggcgactcgtggaaaaataactggcctgtgccaggtcgtaccaactatccgctcatttttgatcgaaactggaagccaaaacccgcttttttctcgattgttgatgcagccagggaggcactggattaa

SEQ ID NO: 278 - protein, 375 aa, Unknown
  Obtained from an environmental sample.
  SIGNAL (1)...(19)
MRNTLILLIPALMMLSCSAGNQDRVPSLHAEFSDAFLIGTALNSEQILGRDTRGLELIRTHFNAITPENITKWEAIHPEPGVYDFKEADAFVDFGQKYNMFMVGHTLVWHSQTPRWVFKDENGALVSREVLLERMRDHIHTVVGRYRGRIHGWDVVNEALNEDGSYRETLWYQIIGTDYILKAFEFAREADPDAELYYNDYSLENPSKRAGAMRIVQYLQEHGAPITGVGTQGHFTLDWPELSEIEQTVIDFASLGMDVMITELDIDVLPQPDDYTGADVNFSAELYDELNPWPNGLPPEIEQELANRYADIFEIYLRHRDKVTRVSFWGVTDGDSWKNNWPVPGRTNYPLIFDRNWKPKPAFFSIVDAAREALD

SEQ ID NO: 279 - DNA, 786 bp, Unknown
  Obtained from an environmental sample.
atgctttctccgacaaggaaactcccgccggccattggactcaccttcctcttcgccgcttcggcgacgccggaaaccacgctcaaggacgccttcgcggaccattttctcgtcggggcggcgctcaatgaatcgcactttgcggagcacaatccggcgcacgccggtctcgtcgccgcaaacttcaatgcgatcaccgcggagaatgtgatgaaatgggaggccgttcatccccggccgggagaatatacgttcggcgccgcggaccggttcgttgagttcggggaaaagaacggcctgttcatcgtggggcacacgctgatctggcattctcaaacgccggcctgggttttcgaggatgagaatggcgcgccgctcggccgcgaggcgctgctggagcggatgcgcgatcacattcacaccgttgccggacgttacaggggccgtgtgaaggggtgggacgtggtcaacgaagccctcgccgaggacggttccctgcgggattcgccgtggcgccgcatcataggcgacgactatttcgtgaaggcctttgagtttgcgcgggaagctgatccggatgcggagttgtattacaacgattactcgattgaaaacgaaccgaagcgcaagggggcggtggcgttggtgaggacgctccaggcggcgggtgttcccgttgccggcgtggggattcagggacacggcaatctccattggccttctccgcggcttgtcgaagaggcgatccgggactttgccagtttgggcgtcaaggtgatgatctga

SEQ ID NO: 280 - protein, 261 aa, Unknown
  Obtained from an environmental sample.
  SIGNAL (1)...(22)
MLSPTRKLPPAIGLTFLFAASATPETTLKDAFADHFLVGAALNESHFAEHNPAHAGLVAANFNAITAENVMKWEAVHPRPGEYTFGAADRFVEFGEKNGLFIVGHTLIWHSQTPAWVFEDENGAPLGREALLERMRDHIHTVAGRYRGRVKGWDVVNEALAEDGSLRDSPWRRIIGDDYFVKAFEFAREADPDAELYYNDYSIENEPKRKGAVALVRTLQAAGVPVAGVGIQGHGNLHWPSPRLVEEAIRDFASLGVKVMI

SEQ ID NO: 281 - DNA, 963 bp, Unknown
  Obtained from an environmental sample.
gtgggcacctgcatgagcggggccgattcgcgcaaccctgcccgtctggagctgatcagaacgcagtacagcatcatcaccccggaaaacgagctcaagcccgattccgttctggatgtggctgccagccgtgctctggccaaggaggacgataccgccgtggccgtgcatttcagcgccgccgctcccatcctgaactttgcccgtgacaacggcatcaaggtgcacggtcatgtgctggtctggcacagccagactcccgaggagttcttccacgagggctataacgcctccgcgccctatgtgagccgcgaggtgatgctggcccgtctggacaactacatccgtctcatctttgaatatatggatgaaaactatcccggcctgatcgtgtcctgggatgtggccaacgaatgcgtggccgacggctccaccgccctgcgcacctccaactggacccgcgtggtggggcaggattttgtggcccgcgccttcgagatcgccgataaatacgcgcccgaagatgtgatgctctgctacaacgattattccactccctatgagcccaagctcaccggcatcgtgaacctgctcaccgagctgacacaggagggtcatatcgacggctacggcttccagagccactacagtgtcggcgatccctccctgcaggcggtcgagaacgcgttcaaaaagatctccgccctggggctcaagctgcgcgtgagcgagctggacatcaaggtagatgccgacagcgagcccaaccgcgcccttcaggccgaccggtatgaggccctgctgcgcatctatatgaaatacggcgtcagcgccgtgcaggtgtggggcgtatgcgacggcaccagctggatcggcgcgagctatcccctcccctttgacgccgggctgcgtcccaagccctccttcttcggcatactccgcgcccttgacgaacagaactga

SEQ ID NO: 282 - protein, 320 aa, Unknown
  Obtained from an environmental sample.
MGTCMSGADSRNPARLELIRTQYSIITPENELKPDSVLDVAASRALAKEDDTAVAVHFSAAAPILNFARDNGIKVHGHVLVWHSQTPEEFFHEGYNASAPYVSREVMLARLDNYIRLIFEYMDENYPGLIVSWDVANECVADGSTALRTSNWTRVVGQDFVARAFEIADKYAPEDVMLCYNDYSTPYEPKLTGIVNLLTELTQEGHIDGYGFQSHYSVGDPSLQAVENAFKKISALGLKLRVSELDIKVDADSEPNRALQADRYEALLRIYMKYGVSAVQVWGVCDGTSWIGASYPLPFDAGLRPKPSFFGILRALDEQN

SEQ ID NO: 283 - DNA, 4161 bp, Unknown
  Obtained from an environmental sample.
atgtataaaagtttcgtcaagaaagtctcccttgtattatctactcttttgctcttagtttcggcgtttcctgtctcatatgcacaaatgaattccatccccgtttatgaagaaacgtttgaaaaccaaggaaactatgtccaatctggtggtgcgaccctcactctagtaaaaaacaaagtgtttgcagggaatgaagatggaactgcactatatattagtaatcgatcgaataactgggacggggcagatttccgtttcacggatcttggattacaagatggaaaaacatatacgatcaatattataggatatgtcgatgaaaatgaagttgttccttcaggagcccaagtgtatttgcaaactgtagataaaacatatggatggttagcaagcgcggacttaaaaaacggagagtcgttcactataaatacaacgttcacccttgacatgagtaaaggggacacccgtcttcgtatacaatccaacgatagtggtaaaaaagtttcattttacgtcgggtatttttcaatttcaattagtgatgtagaaggagaagatggtgggagctctatttcaaggccaccggctttaccttttgaaactattgactttgaagatcaaagtttaagtggatttgagggacgagcaggcacggaaacattgaccgttacgaatgaagcaaatagaactcctggaggatcttatgcactaaaagtggaaaatagatctcaaaattggcatggaccttccttacgcatcgagaaatatattgatttaggttacgaatatacaatttctctatgggttaaacttatttcacccacaagtgcacaaattcagctttctacccaagtcggaagtggaagtggtgcgagttataacaatattttaagtaaagtaattagtgttgatgatggatgggtactgtatgaaggaaagtatcgctacaatagttcgggaggggaatatttaacaatttacgtagaaagcccaaacaatagtactgcatctttttacatcgatgatattcgtttaataaagagtggagacccaatctctgtacaaaaagatcttctccctatcaagagtgtttatgaaggtgacttcttagttggtagtgccgtatcagcgactgatttagagggagagagactcgagcttctcaagttgcattacaatagcataacagcggaaaacgccatgaaacctagctatttacaacctactaaaggaaactttaccttcgaagcagcagatagtattgtaaataaagccctagaagaaggaatgaaagtacatggacatgttctcgtatggcatcagcagacacctgaatggatgaccactagagaagatggaagccctctcggcagggaagaagcgttagaaaatctaaaaaatcacattgaaacagttatgaaacattttggtgatagagtaatttcatgggatgttgtcaatgaagctatcattgataatccacctaatcctgataattgggaggaatcattaagaaaatcaccatggtactattcaatcggttctgattatgttgagcaagcattccgaattgcacgacaagttttggacgaaaatgggtgggatattaagctatattacaatgattacaatgaagataatcaaagaaaagcacaagccatttaccatatggtaaaagagcttaatgaaaaatatgcacaagagcatcctggtaaaagattaatcgatggaattggaatgcaagggcattacagtatacgaacaaatccagataatgtgaaaatgtcattagaaagatttatttcccttggtgtggaagttagtattactgaactcgatattcaagctggaacggataatcatcttacggaagaacagtcaaaagcacaagcatatttatacgctaaattattcaaaatattcaaagaaaatgcatcgcatatctcccgagttacgttatggggattaaatgatgcggcaagttggcgtgcgtcaacaagtccattgttatttgatcgaaatttacaggccaaaccaagttactatgcggtaattgatcctgatacatttatagaagaaaatcctactgtgacagaagagtcgcggaaagcaattgctttgtatggtatccctgtaattgatggaagcatcgattccatttgggaaagtgttccttacatccctattgatcgttaccaaatggcgtggcaaggagcaagcggaactgctaaagttctttgggacgaagggaatctgtatgtattagtacaagttaacgatgaccagttagataagtcgagtacaaatccttgggagcaggattcgatagaggtgtttgtggacgaaaataatgcaaaaacatcgttttaccaagaggatgatggacaatatagagtaaactttgacaacgaaacatcgtttaatccaccaagcattgaaaatggatttatgtccgaaactaatgtatctgggactaattatgtggtggagatgaaaatccctttaagaagtatacaactaaaaaatgggtctgaaatagggtttgatgttcaaattaatgatgggaaaaatggtgctcgtcagagtgtggctgcttggaatgatacgactggaactgcatatatggatacatctgtattcgggacacttactcttttaaccactttagataatgaaaatacaccaggcagcggcacaacaccaggtagtggcacaacaccaggcagtggcacaacaccaggcagcagcacaacaccaggcagcggtacaacaccaggtagcggcacaacaccaggcagtggcacaacaccaggcagcggcacaacaccaggcagtggcacaacaccaggcagtggcacaacaccgggcagcggtacaacaccaggcagtggcacaacaccaggcagtggtacaacaccgggcagtggcacaacaccagtgaagggtgaaaatggtacggttgttttacagccgaaagtagagacgaaagaaaaagacggcaaagtagtagaaaaagtggcaactatttcaacaaatgaagttgaagcgattgtcaaggagctgtcgaatgaaaataaacaagtcgtcgtctccctcggctcgcttccaaaaggtgtagccacaaaagtagatgtgccagctacattatttacacaagcggcaaataaacaagcagaagcaacgattgtgagcgccagtgaacaagcgacgtacaaattgccagtcaaagaagtgcaggcgtctcttgcgacgattgcccggtcactcggtgcaacgatagaacaagttagcatctcgattgaaatgaaagtgaacgatgcgccgtcactacgtgtgaaaccgttgtctgatgcggtagagtttcatgtcgtggcgaaagcaaatggaaaggaacgcgtcatcgatcggtttactcaatatgtcgaacgcgaaatcgcgttaaagcaatcggtcaacgctagtcgtgccattgcagtgcgcgtgaacgatgacggttcacttaccccagtaccgacaacgtttgttggcaacaaagcagtcattaaatcgttgacgaactcgacgtatgttgttgtggaaggaacacatacatttagtgacatccaaccacattgggcgaaaggttatattgaaacactcgcggcaaaacagcttgtcaaagggatgacggacacaacatatcgaccaaatgatcggatgacgcgcgcgcaatttgcggtgttgctcgtacgggcgctaggattgccgagcgaaacgtatgacggtcgctttgctgatgtgaagggaacggagtggtttaacaagaacggtgaattagcagcggcagtcaagttcggaatcattcaaggaaaaacagcttatatgtttgcgccgaatgagccaatcactcgcgcacaagcagctgtcatgatcgaacgggcattgaaactttcgatcgttggctatgatgaggcaacaagcgacaaaacgaaaaaagtgacagatttccgcgatgcaaaacaattgccaacatgggcaaaacaggcgattgaagcagtataccaagcaggcatcatgcaaggacgagatagcggaaactttgatccgacaagccatgtgacgcgtgccgaaatggcgaaggtgttaatggatattttagagttgacaaaacttatttaa

SEQ ID NO: 284 - protein, 1386 aa, Unknown
  Obtained from an environmental sample.
  SIGNAL (1)...(28)
MYKSFVKKVSLVLSTLLLLVSAFPVSYAQMNSIPVYEETFENQGNYVQSGGATLTLVKNKVFAGNEDGTALYISNRSNNWDGADFRFTDLGLQDGKTYTINIIGYVDENEVVPSGAQVYLQTVDKTYGWLASADLKNGESFTINTTFTLDMSKGDTRLRIQSNDSGKKVSFYVGYFSISISDVEGEDGGSSISRPPALPFETIDFEDQSLSGFEGRAGTETLTVTNEANRTPGGSYALKVENRSQNWHGPSLRIEKYIDLGYEYTISLWVKLISPTSAQIQLSTQVGSGSGASYNNILSKVISVDDGWVLYEGKYRYNSSGGEYLTIYVESPNNSTASFYIDDIRLIKSGDPISVQKDLLPIKSVYEGDFLVGSAVSATDLEGERLELLKLHYNSITAENAMKPSYLQPTKGNFTFEAADSIVNKALEEGMKVHGHVLVWHQQTPEWMTTREDGSPLGREEALENLKNHIETVMKHFGDRVISWDVVNEAIIDNPPNPDNWEESLRKSPWYYSIGSDYVEQAFRIARQVLDENGWDIKLYYNDYNEDNQRKAQAIYHMVKELNEKYAQEHPGKRLIDGIGMQGHYSIRTNPDNVKMSLERFISLGVEVSITELDIQAGTDNHLTEEQSKAQAYLYAKLFKIFKENASHISRVTLWGLNDAASWRASTSPLLFDRNLQAKPSYYAVIDPDTFIEENPTVTEESRKAIALYGIPVIDGSIDSIWESVPYIPIDRYQMAWQGASGTAKVLWDEGNLYVLVQVNDDQLDKSSTNPWEQDSIEVFVDENNAKTSFYQEDDGQYRVNFDNETSFNPPSIENGFMSETNVSGTNYVVEMKIPLRSIQLKNGSEIGFDVQINDGKNGARQSVAAWNDTTGTAYMDTSVFGTLTLLTTLDNENTPGSGTTPGSGTTPGSGTTPGSSTTPGSGTTPGSGTTPGSGTTPGSGTTPGSGTTPGSGTTPGSGTTPGSGTTPGSGTTPGSGTTPVKGENGTVVLQPKVETKEKDGKVVEKVATISTNEVEAIVKELSNENKQVVVSLGSLPKGVATKVDVPATLFTQAANKQAEATIVSASEQATYKLPVKEVQASLATIARSLGATIEQVSISIEMKVNDAPSLRVKPLSDAVEFHVVAKANGKERVIDRFTQYVEREIALKQSVNASRAIAVRVNDDGSLTPVPTTFVGNKAVIKSLTNSTYVVVEGTHTFSDIQPHWAKGYIETLAAKQLVKGMTDTTYRPNDRMTRAQFAVLLVRALGLPSETYDGRFADVKGTEWFNKNGELAAAVKFGIIQGKTAYMFAPNEPITRAQAAVMIERALKLSIVGYDEATSDKTKKVTDFRDAKQLPTWAKQAIEAVYQAGIMQGRDSGNFDPTSHVTRAEMAKVLMDILELTKLI

SEQ ID NO: 285 - DNA, 1569 bp, Unknown
  Obtained from an environmental sample.
gtgaaccgaaacacatctccggacttcaagcttggagcaggcgttacggtaagtgatttcctgaacaagggcaggcaatatgaggtcgctgtggcgaatcttgatgaaatgacggccggaaatgccatgaagcagtcttctgtaatgaggcctgacggatccatggatttcactcaggtcagaagattcatcgaggaggccgaacgtgtcggaatgacagtgtacggccatacattggcatggcattcacagcagcagaacgcctatcttaacggtctgatcaagggcaagaagaccgaggtcgagccaggccaggagtcagaggtcgttcttctccagacagatttcaatgacggaaatgtcacattcaacggatggggaaacaattcttcaaggactgtcgagaatggtgcattaaagcttacaaacccttctgtagtaaacagttgggaggcccagttcgcatatgatttttcagaggccttcgagatggacaagacatataagctcaagttcaggatcaagggctcggctgcaggaaagatcgcggcaggcttccagatcactgacggctacctttcggcaggtgagttcggaaccgtagagttcaatacccagtggaaggatgtcgagctctcatgcgtatgttccgctgaaggcggtacacgcttgatcttcagtttcggagagtttgccggagatatctatatcgacgatttctgcttcagtgtggaaggagctggatatatctacgaagatcttaccccggcagagaagaaggagcgccttaccgaggcaatggaccgttggatcaagggaatgatggaggttaccgctaccagggtttctgcgtgggatgctgtcaatgaggcgatttccggccgtgatacaaatggcgacggcttctatgaacttgagtcggcacaatggggaagctcgaacaacttctattggcaggattatctcggctcaggagattatgtgcgtatcgtgatcgcaaaggcccgcaagtattatgaggaattcggcggtacggctcctttgagactcttcatcaatgactacaacctcgaatctgactgggatgacaacaagaagctcaagagccttatccattggatcggtgtctgggagtctgacggagtgacaaagatcgacggaatcggtacccagatgcacgtttcgtattacgagaatcctgatattcaggcaagcaaggagaaacattatgtgcagatgcttcagcttatggcaaatacaggaaagctcgtgaagatctccgagcttgatatgggctatgtagaccgcaacggaaatactgtgggaacagcggacatgaccgaccagcagcatagggccatggcggattattatgacttcatcgtgcgcaagtactttgagatcgtgcctcctgcacagcagtatggcatcacgcagtggtgcatgacggatgctcccggagctatcggcacaggctggagaggcggtgagcctgtgggcctgtgggaccagaattacaaccgcaagtatgcgtacgcaggatttgcaaacggacttagagcgaaataa

SEQ ID NO: 286 - protein, 522 aa, Unknown
  Obtained from an environmental sample.
MNRNTSPDFKLGAGVTVSDFLNKGRQYEVAVANLDEMTAGNAMKQSSVMRPDGSMDFTQVRRFIEEAERVGMTVYGHTLAWHSQQQNAYLNGLIKGKKTEVEPGQESEVVLLQTDFNDGNVTFNGWGNNSSRTVENGALKLTNPSVVNSWEAQFAYDFSEAFEMDKTYKLKFRIKGSAAGKIAAGFQITDGYLSAGEFGTVEFNTQWKDVELSCVCSAEGGTRLIFSFGEFAGDIYIDDFCFSVEGAGYIYEDLTPAEKKERLTEAMDRWIKGMMEVTATRVSAWDAVNEAISGRDTNGDGFYELESAQWGSSNNFYWQDYLGSGDYVRIVIAKARKYYEEFGGTAPLRLFINDYNLESDWDDNKKLKSLIHWIGVWESDGVTKIDGIGTQMHVSYYENPDIQASKEKHYVQMLQLMANTGKLVKISELDMGYVDRNGNTVGTADMTDQQHRAMADYYDFIVRKYFEIVPPAQQYGITQWCMTDAPGAIGTGWRGGEPVGLWDQNYNRKYAYAGFANGLRAK

SEQ ID NO: 287 - DNA, 1695 bp, Unknown
  Obtained from an environmental sample.
atgactattcatctacaaaaaaatctgctctttgcagcagtcttactgacagggcaagcagcgcatgcgctcacctccggatctggcgaggccacgctggatgttaataacagctggggttcaggttattgcgctaacgtcaccattgccaacaacggcagccaagccattacttcctggacggttggcctgaaccttaacggcacgacgatcaataatctttggaacggtaatttgagtggggttacggttacccccgtggcctacaatgcgaatgtggcgccgggtgctaataccagctttggtttctgtgctaatggcagcgcaacccccacgttggcgacgtttgaagttcaaggcggcggtggcgcagccagtagttccagcagttctgctatttcaagcagctccagcagttcggttgccggcggcagcaacagcgtcaccgtacgcatgagcggcgtaaccggagacgaaagcgtgagcctggaaatcggtggtcagaccatcgagacctggaccctgagcgtcggtatgctcgactacaccgtacagaccaacgctaccggtgagttgcgtgttgcgtttaccaatgatgaaggtgaccgcgatgtcgaagtggattacatcatggtcaacggcgtgacctatcaggccgaagatcaggaagataacaccggcgcgtgggacggagagtgtggtgcgggttccttctcgcagatgctgcactgcaacggttctatcggctttggcaatccattcgatggcagcaactcgtcgtccagctccagcaacacttcgagctcgagcagcagctctaaccctaaccctggcaatccgaatttccccgatttcttcgtaggtaacatcaccaccagcggctcagttcgctctgacttcatgcagtattgggatcaaattacgccggaaaacgaaggtaaatggggctccgtagagggaactcgcgaccagtacaactggggtccgctggatgcaatttacaatttcgcccgtgcgaacggtattcctgtaaaagcgcacactctggtgtggggcagtcagcaaccgggttggattggcggcttgagtgccgctgagcagcgcgcggaaattgaagagtggattcgcgattactgcgcacgctacccggatacggcgatgatcgatgtggtgaatgaagctctgccttcgcacgctccggcaaactatgcggccaatgcatttggaagcgattggatcactgaatccttccgtttggcacgtcagtactgtccggatgccgtgctgatctacaacgactataacttcatgacctgggacaccgatgccatcattcagatgattcgcccagccgtgaactccggttatgtcgatgcactgggtcttcaagcgcacagcctgtattccccacaagtctggaccgctcagcaaatccagagcaaattggatcagatttccgagttgggcttgccgctgtacatctccgagtacgacatcgaagcaacgaatgatcagactcagttacagtacatgcagatgcacttcccgatcttctacaaccatcccaacgtggccggtattaccctttggggttatgttgtgggtgctacctggcgtgatggcactggcctgatccaaagcaatggtcagcagcgcccggccatgcagtggttgatggagtatctaaaccgctaa

SEQ ID NO: 288 - protein, 564 aa, Unknown
  Obtained from an environmental sample.
  SIGNAL (1)...(23)
MTIHLQKNLLFAAVLLTGQAAHALTSGSGEATLDVNNSWGSGYCANVTIANNGSQAITSWTVGLNLNGTTINNLWNGNLSGVTVTPVAYNANVAPGANTSFGFCANGSATPTLATFEVQGGGGAASSSSSSAISSSSSSSVAGGSNSVTVRMSGVTGDESVSLEIGGQTIETWTLSVGMLDYTVQTNATGELRVAFTNDEGDRDVEVDYIMVNGVTYQAEDQEDNTGAWDGECGAGSFSQMLHCNGSIGFGNPFDGSNSSSSSSNTSSSSSSSNPNPGNPNFPDFFVGNITTSGSVRSDFMQYWDQITPENEGKWGSVEGTRDQYNWGPLDAIYNFARANGIPVKAHTLVWGSQQPGWIGGLSAAEQRAEIEEWIRDYCARYPDTAMIDVVNEALPSHAPANYAANAFGSDWITESFRLARQYCPDAVLIYNDYNFMTWDTDAIIQMIRPAVNSGYVDALGLQAHSLYSPQVWTAQQIQSKLDQISELGLPLYISEYDIEATNDQTQLQYMQMHFPIFYNHPNVAGITLWGYVVGATWRDGTGLIQSNGQQRPAMQWLMEYLNR

SEQ ID NO: 289 - DNA, 2796 bp, Unknown
  Obtained from an environmental sample.
atgaagttcactttgacaccgctgctgtgcgggttcgccttattgttgggttgcgcggtgcaggcaaccccagccgcttcgttaaagcaggcctatcagccgtttttccatatcggcaccgcagtcagtctggcgcaattacaaccatccaaagaacatgaacgcgctttaattgcgcagcactttaacagtctgaccgccgaaaacctgatgaaatgggaggaaattcaacccacggaaggcaactttgattttaaagcggccgatcagttggttgcgtttgccgaacaacatcaaatgtggatgatcggccataccattctgtggcatgaacaaaccccagactgggtgtttcaggggctggatggcaaacccgccagcaagcagctgctactggcccgcttgaccaaacatatccaaacggtcgttggccgttaccagggccgggtcaatggctgggatgtggtgaatgaagcgctcaatgaagatggcagcctgcgcgataccccgtggcggcgcattttgggtgatgattacattgccaccacttttgcgttggtgcatcaggtcgaccctaaagccaaactctattacaacgattacaacctgtttaaaccggaaaaacgcgccggggtgctgcggattatccaacaactgcagcaaaaaaatgtgcctattcatgccattggtgaacaagcgcattacggccttgattcgcctgcattcaaagacgttgaagattcgatcaacgcttttgctgccaccggcctggacgtgatgctaaccgaactggagatttcagtattgccgtatccatccggcatgacgcagggtgccgatatcagtcagcatcaggaattgcaggaacaactaaacccctatcgcgatggtttgcccaaagccgtcgaacaagcctggcaacaacggtatctcgatttgttttcgctgttattacgccagcagcaaaaactgcatcgcgtgaccttctggggcttagatgatggccaaagctggcgtaataatttcccgatgcgcggtcgcaccgattacccactgctgtttgatcgcaagctgcaagccaaaccgctgttaagcgcactgacggcattagccgcagaccagactaaagccaagcccaaaatgaatcagctgggctttgcgccgacttcgaccaaactgttgattgtgccgggtcggcaatcagtgccttttcatgttttggataccgagaccggccaaacggtgctgcaaggccaaagttcggcggccaggttttggcctgaatcgggggaatgggtcagtgctgccgatttttctgcggtgataactcccggcacctatcagatcaacatctcaggaacgccgccacaaactgtcaagatccaggccgaaccctatgccgcgctgcatgatgcggcaatcaaagcctattattttaaccgcgcctcgctcacactggagccaaagtttgccggaccttgggcacgcgcagcggggcatccggataccaaagtacgggtgcatgcttctgctgcatcggccagcaggccagaaggttatgagctcagcgctgccaaaggctggtatgacgccggtgactacaacaaatacgtggtgaattccggcattaccagttacaccctgttgcaggcctggcaggattttcctgagttttatcaaagccggacctggaatattccggagtccggcaacgcggtaccggacattctcgacgaaaccttatggaatctgcagtggttcagcgccatgcaagacccaaacgacgggggcgtctatcacaagctgactgaactgaatttttcggcaacccaaatgccggaccaagtgacagcagagcgttatgtggtgcaaaaaaccaccgccgcggcactgaatttcgctgcggtgttggccaaagccagtacggtttttgccaaatttgacgcccagttgcccggcctgtcgcaacaataccgtcagcaagcactgctcgcctggcaatgggcgcaaaaaaatccgcagcaaatctatcaacaacccaaagatgtccacactggcgcttatggtgacaaacaactggctgatgaatgggcctgggctggcgccgagctgtatttattgaccggcgagcaaagttatctgcagccactgttggcgctggacacgccaatcagtgcagcatcctgggccagtgtcagcgctttggggtatttttctttggcttcggcgaaacagcttgagcccgcactacggcaacaggtacaacagaaaatccaacaagccgccgcgcaaatcctgcaggaacatcaaacatccgcctatcaggtggcgatgaccaaaaacgattttgtctggggcagtaatgcggtggcaatgaataaagcgatgttgttataccaggcgtggaaaatagcgccaaaaccggagctgctacaggcgatgcaaggtctggttgattacgttttggggcgcaacccgttgcagcagtcttatgtcacagggtttggcgagcaaagcccgcagcagatccaccaccgaccttcggccgccgatgccatcaaagcgccggtaccaggttggttagtcggtggtgcacagccgggtaagcaggataaatgcacttatgccggcgctttacccgctgtcggcgctttacccgctgccagcaccttaccagccaccacttatcttgatgactggtgcagttacgccaccaacgaagtggcgattaactggaatgcacctttggtgtatgtgctggcatggcacctttcgcaaaacaccaagacaccataa

SEQ ID NO: 290 - protein, 931 aa, Unknown
  Obtained from an environmental sample.
  SIGNAL (1)...(22)
MKFTLTPLLCGFALLLGCAVQATPAASLKQAYQPFFHIGTAVSLAQLQPSKEHERALIAQHFNSLTAENLMKWEEIQPTEGNFDFKAADQLVAFAEQHQMWMIGHTILWHEQTPDWVFQGLDGKPASKQLLLARLTKHIQTVVGRYQGRVNGWDVVNEALNEDGSLRDTPWRRILGDDYIATTFALVHQVDPKAKLYYNDYNLFKPEKRAGVLRIIQQLQQKNVPIHAIGEQAHYGLDSPAFKDVEDSINAFAATGLDVMLTELEISVLPYPSGMTQGADISQHQELQEQLNPYRDGLPKAVEQAWQQRYLDLFSLLLRQQQKLHRVTFWGLDDGQSWRNNFPMRGRTDYPLLFDRKLQAKPLLSALTALAADQTKAKPKMNQLGFAPTSTKLLIVPGRQSVPFHVLDTETGQTVLQGQSSAARFWPESGEWVSAADFSAVITPGTYQINISGTPPQTVKIQAEPYAALHDAAIKAYYFNRASLTLEPKFAGPWARAAGHPDTKVRVHASAASASRPEGYELSAAKGWYDAGDYNKYVVNSGITSYTLLQAWQDFPEFYQSRTWNIPESGNAVPDILDETLWNLQWFSAMQDPNDGGVYHKLTELNFSATQMPDQVTAERYVVQKTTAAALNFAAVLAKASTVFAKFDAQLPGLSQQYRQQALLAWQWAQKNPQQIYQQPKDVHTGAYGDKQLADEWAWAGAELYLLTGEQSYLQPLLALDTPISAASWASVSALGYFSLASAKQLEPALRQQVQQKIQQAAAQILQEHQTSAYQVAMTKNDFVWGSNAVAMNKAMLLYQAWKIAPKPELLQAMQGLVDYVLGRNPLQQSYVTGFGEQSPQQIHHRPSAADAIKAPVPGWLVGGAQPGKQDKCTYAGALPAVGALPAASTLPATTYLDDWCSYATNEVAINWNAPLVYVLAWHLSQNTKTP

SEQ ID NO: 291 - DNA, 1230 bp, Unknown
  Obtained from an environmental sample.
atggtcaaagaaagaagttttcttcatcattcattcaataggggcgaaaatggacaggacagtctgatgtggaaaaaagaggcggatgatcgaatctcagagcatagacaaagagatcttgtgatcaacgtaacaaacggtgaaaaaaagccaatagcaggtatagaggttgaaataaagcaaatcagacatgaattcgcctttggttcagcgatgaatgatcaagtgttatttaatcaacaatatgctgattttttcgtgaagtattttaattgggctgtttttgaaaatgaggcaaaatggtatgcgaatgagccacaaagagggagaatcacctacgaaaaagcagatgcgatgctgaattttgcagatcgacatcagcttccagtgagagggcacgctttgttttgggaggtagaggatgcgaatccaagctggctaaggtcactgccaaatcatgaagtatatgaagccatgaaaaaccggcttgagcatgcgggcaatcactttaagggaaggttccgtcattgggatgtaaacaatgaaatgatgcatggttcattttttaaagatcgctttgggaaaaatatttggaagtggatgtatgaagaaacgaaaaaaattgaccctcaagcactattgtttgtgaatgattataatgtgatctcatatggtgaacaccatgcctataaagcgcatatcaatgaactgcgtcagttaggcgcacctattgaggcgattggggttcaaggccattttgaagaacgggtcgatccagtcattgtcaaagagagactcgatgtgcttgctgagctaggtcttccaatatgggtcacagagtacgattcggttcaccctgaccctaatcgaagagcggataacctggaagctttatatcgcgtcgcatttagtcatccagccgtaaaaggagtgctgatgtggggattttgggcaggtgcccattggagaggggaaaatgcagccatcgtgaattatgattggtctttaaatgaagcaggaagacgttatgaaaagcttctaaatgagtggacgacccaaagaattgaaaaaacagatgctaatggccatgtgagatgtccagcatttcacggaacatatgaggttcgaatcggtaaagaaagtaaaatgttgaaacagcagacgattgaacttgattcaaatgaacaaacaccgtttcaactagacgtgatcctgcctcaagaaggatag

SEQ ID NO: 292 - protein, 409 aa, Unknown
  Obtained from an environmental sample.
MVKERSFLHHSFNRGENGQDSLMWKKEADDRISEHRQRDLVINVTNGEKKPIAGIEVEIKQIRHEFAFGSAMNDQVLFNQQYADFFVKYFNWAVFENEAKWYANEPQRGRITYEKADAMLNFADRHQLPVRGHALFWEVEDANPSWLRSLPNHEVYEAMKNRLEHAGNHFKGRFRHWDVNNEMMHGSFFKDRFGKNIWKWMYEETKKIDPQALLFVNDYNVISYGEHHAYKAHINELRQLGAPIEAIGVQGHFEERVDPVIVKERLDVLAELGLPIWVTEYDSVHPDPNRRADNLEALYRVAFSHPAVKGVLMWGFWAGAHWRGENAAIVNYDWSLNEAGRRYEKLLNEWTTQRIEKTDANGHVRCPAFHGTYEVRIGKESKMLKQQTIELDSNEQTPFQLDVILPQEG

SEQ ID NO: 293 - DNA, 1002 bp, Unknown
  Obtained from an environmental sample.
atgaagatgaacagctccctcccctccctccgcgatgtattcgcgaatgatttccgcatcggggcggcggtcaatcctgtgacgatcgagatgcaaaaacagttgttgatcgatcatgtcaacagtattacggcagagaaccatatgaagtttgagcatcttcagccggaagaagggaaatttacctttcaggaagcggatcggattgtggattttgcttgttcgcaccgaatggcggttcgagggcacacacttgtatggcacaaccagactccggattgggtgtttcaagatggtcaaggccatttcgtcagtcgggatgtgttgcttgagcggatgaaatgtcacatttcaactgttgtacggcgatacaagggaaaaatatattgttgggatgtcatcaacgaagcggtagccgacgaaggagacgaattgttgaggccgtcgaagtggcgacaaatcatcggggacgattttatggaacaagcatttctctacgcttatgaagctgacccagatgcactgcttttttacaatgactataatgaatgttttccggaaaagagagaaaaaatttttgcacttgtcaaatcgctgcgtgataaaggcattccgattcatggcatcgggatgcaagcgcattggagtttgactcgcccgtcgcttgatgaaattcgtgcggccattgaacgatatgcgtcccttggtgttgttcttcatattacggaactcgatgtatccatgtttgaatttcacgatcgtcgaaccgatttggcagctccaacgtcagaaatgatcgaacggcaggcagagcggtatgggcaaatttttgctttgtttaaggagtatcgcgatgttattcaaagtgtcacattttggggaattgctgatgaccatacatggctcgataactttccagtgcacgggagaaaaaactggccgcttttgttcgatgaacagcataaaccgaaaccagctttttggcgggcagtgagtgtctga

SEQ ID NO: 294 - protein, 333 aa, Unknown
  Obtained from an environmental sample.
MKMNSSLPSLRDVFANDFRIGAAVNPVTIEMQKQLLIDHVNSITAENHMKFEHLQPEEGKFTFQEADRIVDFACSHRMAVRGHTLVWHNQTPDWVFQDGQGHFVSRDVLLERMKCHISTVVRRYKGKIYCWDVINEAVADEGDELLRPSKWRQIIGDDFMEQAFLYAYEADPDALLFYNDYNECFPEKREKIFALVKSLRDKGIPIHGIGMQAHWSLTRPSLDEIRAAIERYASLGVVLHITELDVSMFEFHDRRTDLAAPTSEMIERQAERYGQIFALFKEYRDVIQSVTFWGIADDHTWLDNFPVHGRKNWPLLFDEQHKPKPAFWRAVSV

SEQ ID NO: 295 - DNA, 1134 bp, Unknown
  Obtained from an environmental sample.
atgagatccgtccgcatcgtcacctttgctctcgccgccgcgctggccgtcccgctggtgacgtcgacggccacggccaagccgtccgccgaccacgaggccgcgccccactccaacgccaagttcgaccgcctgcgctgggccgcccccgaagggttcttcataggctccgcggcggccggcggcggccaccacctcgaacaggactacccggaccccttcaccttcgacaagaagtaccggaagatcctgggccagcagttcaactcggtctccgccgagaaccagatgaagtgggagttcatccaccccgagcgcgaccagtaccgcttcgaggaggccgacgccatcgtcgagttcgcccagcggaaccgccaggccgtgcgcgggcacaccctcctgtggcacagccagaaccccgaatggctggaggagggcgacttcaccaaggaggaactgcgcgccatcctcaaggaccacatcgacacggtcgtcggccgctacgccggcaagatccagcagtgggacgtggccaacgagatcttcaacgaccaggccgagctgcgcaccgacgagaacatctggatacgtgagctcggcccggagatcgtcgcggacgccttccgctgggcccacgaggccgaccccgaggccaagctgttcctcaacgactacaacgtcgagggcatcaacgccaagagcgacgcctactacgagctcgcccaggagatgctggagcagggcgtgccgctccacggattcggcgcccagggccacctgagcacccgctacggcttcccgggcgacctgcagcagaacctgcagcggttcgccgacctcggtctggagaccgccatcaccgagatcgacgtccgcatggacctcccggcgagcggcaagcccaccaaggagcagctgcggcagcaggccgactactaccagcaggcactgtcggcctgcctggccgtgaacgactgcaactccttcaccatctggggcttcaccgacaagtactcgtgggtgccggtcttcttcgagggtgagggcagcgccacggtcatgacggagaagttcgtccgcaagccggccttcttcgccctgcagtccaccctgaaggaggcgcgcaagcgctga

SEQ ID NO: 296 - protein, 377 aa, Unknown
  Obtained from an environmental sample.
  SIGNAL (1)...(26)
MRSVRIVTFALAAALAVPLVTSTATAKPSADHEAAPHSNAKFDRLRWAAPEGFFIGSAAAGGGHHLEQDYPDPFTFDKKYRKILGQQFNSVSAENQMKWEFIHPERDQYRFEEADAIVEFAQRNRQAVRGHTLLWHSQNPEWLEEGDFTKEELRAILKDHIDTVVGRYAGKIQQWDVANEIFNDQAELRTDENIWIRELGPEIVADAFRWAHEADPEAKLFLNDYNVEGINAKSDAYYELAQEMLEQGVPLHGFGAQGHLSTRYGFPGDLQQNLQRFADLGLETAITEIDVRMDLPASGKPTKEQLRQQADYYQQALSACLAVNDCNSFTIWGFTDKYSWVPVFFEGEGSATVMTEKFVRKPAFFALQSTLKEARKR

SEQ ID NO: 297 - DNA, 1842 bp, Unknown
  Obtained from an environmental sample.
ttgaggtcaggcgcgttctgtttcatcatagtcgttttaatcctgaaccttatatgcagggagttgtatgagtgtaaaaaagttgttaccgcagcactggtatgcttggctttcgggtcatcgctgacttgggggcaatgcaccacatttaccaccagtaccattcggaattgcgatggtatagattacgagctctggagccagaataactctggcacgaccaatatgcaaatcacgggagggaactcgaatccaaacggtggaacctttgaggcgacatggagtggcacgatcaatgttctattccgcgcgggtaaaaaatggggcacatccagcaccagtacccccaaaaccatcggcaatatctctcttgaattcgcagcgacatggagttcggtcgataatgtgaaaatgcttggcatctatggctgggcgtattatccctcgggaagcgaaccaacaaaaacggaaagcggtcaaagcacgaacttttccaatcagattgagtattacatcattcaagaccgcggtagctataacccggcatccggcggcaccaacgccaaaaagtacggtgaagggacgatcgacggaatcgcgtatgatttttatgtcgccgaccgtatcggccaggccatgctgacaggaacgggaaatttcaaacagtacttcagcgtgccgaagagcacaagcagtcacaggcaaagcggcacggtttccgtctccaaacattttgaggcctgggaaaaagcgggcatgaagatgatggattgtcggttatacgaagtcgcgatgaaagtggaatcgtataccggttccgcgaatggcaacggctcggcgaaagtgaccaaaaatctcctcacgatcggcggaagcagcagcaacgagtttagtctcgtaacgaatgtttctcctgccagcgcgggaacggtgtccaagagcccggacaacgcatcctatgccccgaacgcctccgttcagctcacggcgaccccgaataccggttggaagtttgtgggctgggaaggggacgcctcgggttccacgagcccaaccagcgttaccatgagcaaagacctcacggttacagcgaagtttgagctggtatcggaagaaggcagcacaaacctgatccaggatggcaacttcccgagcggcagcgtaatctctacagatgacggggcttcatggaaactcggacaaggggaaaactggggaaattccgcagccacaacgagcgtcagcaatggaatcgcgacagtcaatgtgacaactgtcggagcggaagcttatcaaccgcagcttgtacagtacggtttgggactcgacatggacatgagttacaaacttaccttcaaggcaagagccgatgcggcaaggaagattgaagttgcgttccagcaggcggtggatccttgggctggttatgcttcccaggaattcgacctgaccacgaccgatcaggatttcgagttcgtattcacgatgaccaacgccagcgacccggcatcacagttcgcgttcaatcttggccaggcgacaggcgatgtctatatcagtgatgttaaactggtatacacgacaggcaccacacccatatcccgcaccatagtccgcggcaatacggcattcgtctcggtaagtggcagaaccctgaatatttcggcagtcgacgcgtccacacttcagatcaaggtagtagatataaacggaaaggtaagagcgaatttcaacacggctggtgcagcaagtgtttccttgtccaatattcctgcgggccagtacttcgttggtatcacaggcacaggcataaaacaaatctcaccgatcgttttggaataa

SEQ ID NO: 298 - protein, 613 aa, Unknown
  Obtained from an environmental sample.
MRSGAFCFIIVVLILNLICRELYECKKVVTAALVCLAFGSSLTWGQCTTFTTSTIRNCDGIDYELWSQNNSGTTNMQITGGNSNPNGGTFEATWSGTINVLFRAGKKWGTSSTSTPKTIGNISLEFAATWSSVDNVKMLGIYGWAYYPSGSEPTKTESGQSTNFSNQIEYYIIQDRGSYNPASGGTNAKKYGEGTIDGIAYDFYVADRIGQAMLTGTGNFKQYFSVPKSTSSHRQSGTVSVSKHFEAWEKAGMKMMDCRLYEVAMKVESYTGSANGNGSAKVTKNLLTIGGSSSNEFSLVTNVSPASAGTVSKSPDNASYAPNASVQLTATPNTGWKFVGWEGDASGSTSPTSVTMSKDLTVTAKFELVSEEGSTNLIQDGNFPSGSVISTDDGASWKLGQGENWGNSAATTSVSNGIATVNVTTVGAEAYQPQLVQYGLGLDMDMSYKLTFKARADAARKIEVAFQQAVDPWAGYASQEFDLTTTDQDFEFVFTMTNASDPASQFAFNLGQATGDVYISDVKLVYTTGTTPISRTIVRGNTAFVSVSGRTLNISAVDASTLQIKVVDINGKVRANFNTAGAASVSLSNIPAGQYFVGITGTGIKQISPIVLE

SEQ ID NO: 299 - DNA, 1047 bp, Unknown
  Obtained from an environmental sample.
atgtttttgagtctcaaaagagtggcggcgcttgtttgcgtcgccggtctcggcatctctgcggcccaagcacagacctgcctgacctcgagtcaaaccggcactaacaacggcttctactattcgttctggaaagacaatcccggcaccgtgaatttctgtctgcagtccggcggccgctacacctccaactggagcggcatcaacaactgggtcggcggaaagggatggcagacgggttcccgcagagtggtgaactactcgggcagcttcaattcgcctggcaatgggtacctgactctctatgggtggaccaccaatccgctcatcgagtactacattgtcgacaactggggcacgtatcgtccgccgggtgggcaggggttcatgggcacggtgaccagcgatggcgcgacgtatgacgtctatcgcacgcagcgcgtcaatcagccctgcatcaccggcagcagttgcacgttctatcaatactggagcgtgcggcagtcgaagcggaccggtggcacgatcaccaccggcaaccacttcgatgcctgggccagctacggaatgaatctgggcgctcacaactaccagatcatggcgaccgagggctatcaaagcagcggcagctctgacatcacggtgagtgagggaagcagcagcagtagcagcggtggtggcagcagcacgagcagcagtggcggcggcggcaccaagagcttcacggtccgggcgcgcggaaccgcgggtggtgagtccatcacgctgcgtgtgaacaatcagaacgtgcagacctggacgctgggcaccagcatgacgaactacacggcatcgacgtcgttgagcggtggcatcaccgtggcttacacgaacgacagtggcaatcgcgacgtgcaggtggattacatcatcgtgaacggctcgacgcgtcagtcagaagcgcagagctacaacaccgggctctatgccaacggtagttgtggtggcggctccaatagcgaatggatgcattgcaacggcgccattggctacgggaatacgccgtag

SEQ ID NO: 300 - protein, 348 aa, Unknown
  Obtained from an environmental sample.
  SIGNAL (1)...(24)
MFLSLKRVAALVCVAGLGISAAQAQTCLTSSQTGTNNGFYYSFWKDNPGTVNFCLQSGGRYTSNWSGINNWVGGKGWQTGSRRVVNYSGSFNSPGNGYLTLYGWTTNPLIEYYIVDNWGTYRPPGGQGFMGTVTSDGATYDVYRTQRVNQPCITGSSCTFYQYWSVRQSKRTGGTITTGNHFDAWASYGMNLGAHNYQIMATEGYQSSGSSDITVSEGSSSSSSGGGSSTSSSGGGGTKSFTVRARGTAGGESITLRVNNQNVQTWTLGTSMTNYTASTSLSGGITVAYTNDSGNRDVQVDYIIVNGSTRQSEAQSYNTGLYANGSCGGGSNSEWMHCNGAIGYGNTP

SEQ ID NO: 301 - DNA, 642 bp, Unknown
  Obtained from an environmental sample.
atgtttaagtttacaaagaaattcttagttgggttaacggcagctttgatgagtatgagcttgttttcggcaaacgcctctgcagctaacacagactactggcaaaattggactgatgggggcggaacagtaaacgctgtcaatgggtctggcgggaattacagtgtgaattggtctaataccggaaatttcgttgttggtaaaggttggactacaggttcgccatttaggacgataaactataatgccggagtttgggcgccgaacggcaatgcatatttgactttatatggttggacgcgatcccctctcatagaatattatgtagtggattcatggggtacttatagacctactggaacgtataaaggtacggtttacagtgatgggggtacatatgacgtgtacacaactacacgttatgatgcaccttccattgatggcgataaaactacttttacgcagtactggagtgttcgccagtcgaagagaccaactggaagcaacgctacaatcactttcagcaatcacgttaacgcatggaagagatatgggatgaatctgggtagtaattggtcttaccaagtcttagcgacagagggatatcgaagtagtggaagttctaacgtaacagtgtggtaa

SEQ ID NO: 302 - protein, 213 aa, Unknown
  Obtained from an environmental sample.
  SIGNAL (1)...(28)
MFKFTKKFLVGLTAALMSMSLFSANASAANTDYWQNWTDGGGTVNAVNGSGGNYSVNWSNTGNFVVGKGWTTGSPFRTINYNAGVWAPNGNAYLTLYGWTRSPLIEYYVVDSWGTYRPTGTYKGTVYSDGGTYDVYTTTRYDAPSIDGDKTTFTQYWSVRQSKRPTGSNATITFSNHVNAWKRYGMNLGSNWSYQVLATEGYRSSGSSNVTVW

SEQ ID NO: 303 - DNA, 1404 bp, Unknown
  Obtained from an environmental sample.
ttgactataaaggcctggcccgggacggctgccagctataataccaatagaggttttatcatgtcctacgctcagtttaagggggccgctaccctagcgacgtccttcctgctcgcagtcaccttgacagcctgtggaggcagcaaatccaaacccgttctgccagacccatcgaacagcagctcgtcatcaagcagcagctcgtcatcaagcagcagctcctcaagttcctccagtagcagttcgagctcttctagtgctccctccagccaaacgttcttcattgagccggatttccagcttcacaccctggcggacttcccgattggagtggcagtctcggcagccaatgagccatacagcatcttcaaccaaaccgatggtactgatcggcaggatgtgatcctggagcatttcaacgaaatgaccgctggcaacatcatgaaaatgagctacgtgtacgcaggtcaacgtgcaaatcagcaacccgatcaattcgacttcagcagagctgatgagctggttgggtttgcccacgcaaacagtgtgaagattcacggtcacgccctcgtttggcacgccgactatcaagttccgggtttcatgcagaattatgatggcgactttgctgagatgttggccaatcacgcgcggagtgttgtggaacattttgacgaagagtttccaggtaccgtggtcagctgggatgtggtcaacgaggcgataaccgacaacttcggaaccgatacaaatggctggcgccggtcgctgttttacaacgcgctgccgcccgcgacagaagacgatattcctgagtacatccgcgttgccttccaggccgctcgcgatgccaacccggacatcgacctctattacaatgattacgacaataccgccaacaccaaccggctgaacaaaaccctgcagatcgccgatgccctggccgaggacgagctgatcgacggtgtgggattccagatgcacgtctatatgacgtacccgagccttagtcacttccaaaacgcgtttcaagaagtggttgatcgaggcttgaaggtgaagatcaccgagctggacgtatcggtggtcaacccatacggtcagagcactccgccaccgcagcccgtctacgatgaagcgttggcaggcgcacagaaaaagcggttctgcgatatcaccagagtctatctggaaacggttccggctgagcttcgcggcggtctcactgtttgggggcttgccgacaacgaaagctggttgatgcaacagttcaggaacgcaacgggagcgaactacaccgacgtgtggccgttgttgttcaacgccgacctgtcagccaaacctacactccaaggcgtggccgatgctctgcagggtctcccctgcaccaccgacctcgactaa

SEQ ID NO: 304 - protein, 467 aa, Unknown
  Obtained from an environmental sample.
  SIGNAL (1)...(74)
MTIKAWPGTAASYNTNRGFIMSYAQFKGAATLATSFLLAVTLTACGGSKSKPVLPDPSNSSSSSSSSSSSSSSSSSSSSSSSSSSSAPSSQTFFIEPDFQLHTLADFPIGVAVSAANEPYSIFNQTDGTDRQDVILEHFNEMTAGNIMKMSYVYAGQRANQQPDQFDFSRADELVGFAHANSVKIHGHALVWHADYQVPGFMQNYDGDFAEMLANHARSVVEHFDEEFPGTVVSWDVVNEAITDNFGTDTNGWRRSLFYNALPPATEDDIPEYIRVAFQAARDANPDIDLYYNDYDNTANTNRLNKTLQIADALAEDELIDGVGFQMHVYMTYPSLSHFQNAFQEVVDRGLKVKITELDVSVVNPYGQSTPPPQPVYDEALAGAQKKRFCDITRVYLETVPAELRGGLTVWGLADNESWLMQQFRNATGANYTDVWPLLFNADLSAKPTLQGVADALQGLPCTTDLD

SEQ ID NO: 305 - DNA, 3705 bp, Bacteria
atgaagagtattgtaaacagagttgtatctatcgttacagctttaataatgatttttgggacatcactgctttcacaacacataagggcatttgctgatgacactaatacaaatctggtttctaatggggactttgagacaggcacaattgatggctggattaagcaaggtaatcctacattagaagtaacgactgaacaagcaattgggcaatacagtatgaaagttacgggtagaacacagacatatgaaggacctgcatatagctttttaggaaaaatgcagaaaggtgaatcatataatgtatcgcttaaagttagacttgtttctggacaaaattcttctaatccttttattaccgtgactatgtttagagaagatgacaatggcaagcattatgatacaatagtttggcaaaaacaagtttctgaagattcatggactactgtaagcgggacttatacattagattatactggaacattaaaaacattatacatgtatgtagaatcacccgatccaacgctggaatactatattgatgatgttgtagtgacaccacaaaatccaatacaagtaggaaatgtgattaccaatggaacttttgaaaatggaaatacttcaggatgggttggaacaggctcatctgttgttaaggcagtgtatggagtggctcatagcggaggttatagtttattgacgacagggagaacagctaattggaatggtcctagctatgatttgactggcaaaatagtaccaggtcaacaatacaatgttgatttttgggtgaaatttgttaatggcaatgatacagaacaaataaaggctactgttaaagcgacttctaacaaagacaattatatacaagttaatgattttgtaaatgtaaataaaggcgaatggacagaaataaaaggcagttttactttacctgtgacagattacagcggtgtcagcatctatgtagaatctcaaaatcctactttagagttttacattgatgatttttctgtaataggtgaaatttcaaataatcagattacaatacaaaatgatattccggatttatattcagtattcaaagattatttccccatcggtgttgcagttgattcgagtagattaaatgatgctgatccacatgctcaattgactgctaaacattttaatatgcttgttgcagaaaatgccatgaaaccggaaagcttgcagcctacagagggaaactttacctttgataatgctgataagattgttgattatgaaatagcacataatatgaagatgagaggtcatacattgctttggcataatcaggttccggattggtttttccaggacccatctgatccgtctaaaccagcttcaagggatctgctgcttcaaagattaagaacgcacataacaactgtgttagatcattttaaaacaaaatacggttctcaaaatccaataatcggatgggatgttgtaaatgaggttcttgatgataatggcaatttaagaaattctaagtggttacaaattataggacctgattatatagaaaaagcttttgaatatgcgcatgaggcagatccatctatgaaattgtttattaatgattacaacatcgaaaataatggcgttaaaacacaggcaatgtatgatttagtgaaaaagttaaaaagtgaaggtgtgcctataaacggaataggcatgcaaatgcacataagcataaattcaaatatagacaatataaaagcttctatagaaaaacttgcatcattaggtgtggaaatacaggtaactgaattagatatgaacatgaatggtaatgtatctaacgacgcattgcttaagcaagcgagattgtataaacaattatttgacttatttaaagcagaaaaacaatatataactgctgtagttttttggggagtttcagatgatgtaagttggcttagtaagccaaatgctccactactttttgattcaaagttacaggcaaagccagcatactgggcaattgtagatcaaggcaaagccatacctgacattcaatctgcaaaagctttagaaggatcaccgacgattggtgcaaatgttgatagttcttggaaacttgtaaaaccattgtatgctaatacttatgtgaaaggaactattggagcaactgctgctgttaaatctatgtgggatactaaaaacttatatttgttagtacaagtttcagacaatactccatctaataatgatggtatcgagatttttgtggataagaatgacaacaaatctactacctatgaaagtgacgatgaacattatatagttaagagggatggtacagggagttcaaatattacaaagtatgtaatgtctaatgctgatggatatgtagcacagatagctattccaattgaagacattagtcctgtgctgaatgataaaattggatttgatatcagaataaatgatgaccaaggcagtggcaatataaatgcgataacagtttggaatgattatacaaacagtcaagatactaatacagcatattttggagatttagtattatcaaaacctgcacagattgcaacagctatatatggcactcctgttattgacggtaaagtagatggtatttggaataatgctgaagctatttcgacaaatacatgggtcttgggttcaaatggtgctactgcaacagcaaaaatgatgtgggacgataaatatctttatatattggcagatgtaacagataacaatttaaataaatccagtgtgaatccttatgaacaggattctgtggaagtttttgtagatcagaataatgataagacaacttattatgaaaatgatgatgggcagtttagagttaactatgataatgaacaaagttttggaggaagcactaattcaaatggatttaagtcggcaacaagtcttacacaaaatggatatattgtagaagaagctattccttggacgagtattactccgtcaaatggtactatcatagggtttgacttgcaagttaacgatgcagatgaaaatggtaagaggacaggtattgtcacatggtgtgatccaagcggaaattcttggcaagatacttctggatttggaaacttgatgcttacaggtaagccatctggtgtccttaaaaaggttgtggcatttaatgacataaaagacaattgggcgaaagacgtaatagaagtattagcgtcaaggcacatagtagaagggatgacagacacccagtatgaaccaaacaagacagtgacgagagcagaatttacagcaatgatactgaggctattaaacataaaagaagaagcatacagcggagaatttagcgatgtaaaaagtggagactggtatgcaaacgcgatagaagcagcatacaaaacaggaataatcgaaggtgacggaaagaacgcaaggccaaatgacagcataacaagagaagagatgacagcaatagccatgagggcatacgagatgctgacacagtacgaagaagagaatataggtgcgacaacatttagcgacgacaaatccataagcgattgggcaagaaatgtagtggcaaatgcagcgaaattaggaatagtaaatggtgagccaaataacgtatttgcacctaaaggaaatgccacaagagcagaagcagcagctatcatatacggcttattagaaaaaacaaataagctttaa

SEQ ID NO: 306 - protein, 1234 aa, Bacteria
  SIGNAL (1)...(32)
MKSIVNRVVSIVTALIMIFGTSLLSQHIRAFADDTNTNLVSNGDFETGTIDGWIKQGNPTLEVTTEQAIGQYSMKVTGRTQTYEGPAYSFLGKMQKGESYNVSLKVRLVSGQNSSNPFITVTMFREDDNGKHYDTIVWQKQVSEDSWTTVSGTYTLDYTGTLKTLYMYVESPDPTLEYYIDDVVVTPQNPIQVGNVITNGTFENGNTSGWVGTGSSVVKAVYGVAHSGGYSLLTTGRTANWNGPSYDLTGKIVPGQQYNVDFWVKFVNGNDTEQIKATVKATSNKDNYIQVNDFVNVNKGEWTEIKGSFTLPVTDYSGVSIYVESQNPTLEFYIDDFSVIGEISNNQITIQNDIPDLYSVFKDYFPIGVAVDSSRLNDADPHAQLTAKHFNMLVAENAMKPESLQPTEGNFTFDNADKIVDYEIAHNMKMRGHTLLWHNQVPDWFFQDPSDPSKPASRDLLLQRLRTHITTVLDHFKTKYGSQNPIIGWDVVNEVLDDNGNLRNSKWLQIIGPDYIEKAFEYAHEADPSMKLFINDYNIENNGVKTQAMYDLVKKLKSEGVPINGIGMQMHISINSNIDNIKASIEKLASLGVEIQVTELDMNMNGNVSNDALLKQARLYKQLFDLFKAEKQYITAVVFWGVSDDVSWLSKPNAPLLFDSKLQAKPAYWAIVDQGKAIPDIQSAKALEGSPTIGANVDSSWKLVKPLYANTYVKGTIGATAAVKSMWDTKNLYLLVQVSDNTPSNNDGIEIFVDKNDNKSTTYESDDEHYIVKRDGTGSSNITKYVMSNADGYVAQIAIPIEDISPVLNDKIGFDIRINDDQGSGNINAITVWNDYTNSQDTNTAYFGDLVLSKPAQIATAIYGTPVIDGKVDGIWNNAEAISTNTWVLGSNGATATAKMMWDDKYLYILADVTDNNLNKSSVNPYEQDSVEVFVDQNNDKTTYYENDDGQFRVNYDNEQSFGGSTNSNGFKSATSLTQNGYIVEEAIPWTSITPSNGTIIGFDLQVNDADENGKRTGIVTWCDPSGNSWQDTSGFGNLMLTGKPSGVLKKVVAFNDIKDNWAKDVIEVLASRHIVEGMTDTQYEPNKTVTRAEFTAMILRLLNIKEEAYSGEFSDVKSGDWYANAIEAAYKTGIIEGDGKNARPNDSITREEMTAIAMRAYEMLTQYEEENIGATTFSDDKSISDWARNVVANAAKLGIVNGEPNNVFAPKGNATRAEAAAIIYGLLEKTNKL

SEQ ID NO: 307 - DNA, 3729 bp, Unknown
  Obtained from an environmental sample.
atgaaatccgccatcggcgacgctgcgtttatggcggcgatggaacgcaactccgacatcgtgacgatgcagtgctacgcacctatctttgtcaatgtcaatcccggcgggcggcagtggcgccccaatttgatgggctacgatgcgttaagcgctttcggctcgccctcgtattacgccatcaaaatgttcagcaacaatttgggcgatacgattttgaagcccagtctcagcggtgcgcgcctgccagtttccgttacacaagagcagaaaagcggcacgattttcattaaattggtgaacccgcaaacgacgccacagagcgtaaaaattgatctcaaaggcgtgcgctccgtcgaattcagcggcaccgccactgttttagctgccgactccggcgcgcttaactccattgatgcgcctaccaaagtcgttcctgtcacgcgcagaattactggaatcagcccctcgtttgcgcaaacgctggagccgtattcgattactgttttgcaaatcaaggccactgctctgccaacggcgacagcaaacgccgttgcgccgccaaccttcaccacggagccaaaagtgaacaccaccacgcccgttactattcccgttgcgacttcgcagccgcagccagtttcgcaaccgtcgccagatgcaaacgctatcgcgccgctgaaaaacgctttcaaaggcaagttcctcattggcaccgtgttgagcgggccagacctgcgcggccagcaaacgcgcagcgtgggtatcgccaccacgcatttcgacgcctttacggcagaaaacgaaatgaagccggatgcgatgcagcctcgcgaaggacaattcaactttgctgccggcgaccgcttagtggaactggccgaaaaaagcggcgccacgcccatcggccacacgctaatctggcactcgcaaacaccacgctggttctttgaagggccggacggacaaccggcgaatcgtgaattggccttggcgcggatgcgcaagcatattgcaaccgtcgtcggccactacaaagggcgcgtcaagcagtgggacgtggtgaacgaagccataaacgatggccccggcgtgctgcgccaaagcccgtggctgcgcgctatcggcgaagactacatcgctgaagcgtttcgagccgcgcacgccgccgaccctgacgcaattctcatctataacgattacaacatcgaaatgggctacaaacggcccaaagcaatccaactcttaaaatctctggttgatcagaaagtgccgattcatgcggttggtattcagggccactggcgtatggacaccaacctcaccgaagtggaacaagctattaaagaattctcggcgctgggcctgaaggtgatgatcactgaactcgacatcggtgttttgccgacgcgttatcagggcgctgatatttcgcaggtgcaaaacatgacgcctgaacagcgcgccgccgtgaacccatataccaatggtttgcccgacgacgtagcgcaaaaacacgccgataaatatcgccaggccttcgatattttcctgcgctacaaagatgtcatcgaacgcgtcacgttctggggtgtggacgatgctcattcgtggctgaacggtttcccgattcgcgggcgcaccgattacccattgcttttcgaccggcagggcaaacctaaacccgcctttttcgccgtgcaaaacctggctttaggcgtgaccgccgcgccgcaatcgaatgcttcgtctgcacccagagctgtcgctcaagctgcgccggcaaccagcaatattcgtggccaggaatttccacgggtcgaaagcgatttgcgtgtgacgtttcgcatcaaagcccccgaagcgcaaaaagtgcagttcgatttaggcaagccttacgacgcgacccgcgatgctgaaggcaactggacggcaaccaccgagccgcaggtgcccggctttcactattacaatttggtgattgacggcgtgcgcgtgaacgacccggccagcgaaaccttttacggcgcgggccgccagatgagcggcatcgaaatccccgaccctgacagcgccttttattcgccgcaaaacgtgccgcacggcgaagtgcgcgagcgctggtatttttccaacaccacgcaggcgtggcgtcgcattttcatttatacgccgccgggttatgacacgaatcaagtggagcgttttcccgttttgtatttacagcatggcggcggcgaagatgagcgcggctggcctcaacagggtcgcatgagctttatcatggataatctcatcgccacacgtaaagccaaaccgatgcttgtggtgatggaacaaggctatgcgcgcaagcccaacgagccgcaggtgccgttgcgcccgcccggcggtagcgccggagccatgccccccgatttcaatcgcatgttcggcacactgggtgaagtgttcaccaaagacctgattccctttattgatgctaattaccgcaccaaaaccgaccgcgaaaaccgcgccatggccggactttcgatgggcgggatgcaaagtttccttattggcttgtcgaacaccgatttattcgcgcacatcggaggcttcagcggcgcgggcggcggtttcggtggcggcaccttcgacgcaaaaacggcgcacggcggtgtaatggccgacgccgacgcgttcaacaaaaaagttcgcacgctgtttctcagcatcggcacagcggaaaacgaacgctttcagagcagcgtgcgcggttaccgcgatgcgctgaccaaagcgggcatcaaaaccacattctacgaatcgcccggcacctcacatgaatggctgacatggcggcgtagcctgaaagaattcgcaccgctcttgtttcaagaagtcgaagtgcaaattgagcgcggcccgaatgcgcgcccaattgcgccgcaaccgattaatctcggccccgacgataaacccgcatttcccccggtgcccgccggtttcgatgtccgccgcaacgatattccgcatggcgaaatcaaactcgtggaatatccatccgctacagtgggcacaaatcgtaagatgcaggtttacacgccgcccggttacaatccgcaagaaaagtatgcggtgctttatctgttgcacggaatcggcggcgacgagtgggaatggaaaaatggcggcacgccggaagtgattctcgataatctttacgccgcgaaaaaactccagccgatgattgtggtcatgcccaatggccgcgcgcaaaaagatgaccgtccaatcggcaatgtgttcgcatcagcgcctgcttttgaaaccttcgagaaagatttactcaacgacgtaattccgtttatcgaaaagaattatccagtcaaaaccggcgccgaaaatcgcgcgcttgcgggcctttcgatgggcggtgggcaatcgctgaactttggtctgggcaatctcgacacctttgcgtgggtcggcggcttttcttcggcgcccaacacgcgcactggcgcaaggctattagccaatcccgacgatgccaaaaagaagctgaaattgttatgggtttcgtgtggcgataaagacggcttgtttttcatcagccagcgcacgcatcgctatctcgccgaaaacaatgtgccacacgtctggcatgtgcagcccggcggccacgatttccgagtgtggaagcaagacctttataacttttcgcaactgctgttccgctaa

SEQ ID NO: 308 - protein, 1242 aa, Unknown
  Obtained from an environmental sample.
MKSAIGDAAFMAAMERNSDIVTMQCYAPIFVNVNPGGRQWRPNLMGYDALSAFGSPSYYAIKMFSNNLGDTILKPSLSGARLPVSVTQEQKSGTIFIKLVNPQTTPQSVKIDLKGVRSVEFSGTATVLAADSGALNSIDAPTKVVPVTRRITGISPSFAQTLEPYSITVLQIKATALPTATANAVAPPTFTTEPKVNTTTPVTIPVATSQPQPVSQPSPDANAIAPLKNAFKGKFLIGTVLSGPDLRGQQTRSVGIATTHFDAFTAENEMKPDAMQPREGQFNFAAGDRLVELAEKSGATPIGHTLIWHSQTPRWFFEGPDGQPANRELALARMRKHIATVVGHYKGRVKQWDVVNEAINDGPGVLRQSPWLRAIGEDYIAEAFRAAHAADPDAILIYNDYNIEMGYKRPKAIQLLKSLVDQKVPIHAVGIQGHWRMDTNLTEVEQAIKEFSALGLKVMITELDIGVLPTRYQGADISQVQNMTPEQRAAVNPYTNGLPDDVAQKHADKYRQAFDIFLRYKDVIERVTFWGVDDAHSWLNGFPIRGRTDYPLLFDRQGKPKPAFFAVQNLALGVTAAPQSNASSAPRAVAQAAPATSNIRGQEFPRVESDLRVTFRIKAPEAQKVQFDLGKPYDATRDAEGNWTATTEPQVPGFHYYNLVIDGVRVNDPASETFYGAGRQMSGIEIPDPDSAFYSPQNVPHGEVRERWYFSNTTQAWRRIFIYTPPGYDTNQVERFPVLYLQHGGGEDERGWPQQGRMSFIMDNLIATRKAKPMLVVMEQGYARKPNEPQVPLRPPGGSAGAMPPDFNRMFGTLGEVFTKDLIPFIDANYRTKTDRENRAMAGLSMGGMQSFLIGLSNTDLFAHIGGFSGAGGGFGGGTFDAKTAHGGVMADADAFNKKVRTLFLSIGTAENERFQSSVRGYRDALTKAGIKTTFYESPGTSHEWLTWRRSLKEFAPLLFQEVEVQIERGPNARPIAPQPINLGPDDKPAFPPVPAGFDVRRNDIPHGEIKLVEYPSATVGTNRKMQVYTPPGYNPQEKYAVLYLLHGIGGDEWEWKNGGTPEVILDNLYAAKKLQPMIVVMPNGRAQKDDRPIGNVFASAPAFETFEKDLLNDVIPFIEKNYPVKTGAENRALAGLSMGGGQSLNFGLGNLDTFAWVGGFSSAPNTRTGARLLANPDDAKKKLKLLWVSCGDKDGLFFISQRTHRYLAENNVPHVWHVQPGGHDFRVWKQDLYNFSQLLFR

SEQ ID NO: 309 - DNA, 1830 bp, Unknown
  Obtained from an environmental sample.
ttgaaaaaactcacaatcgccctatcccttgcaatcacttttgccgcgccagtttttgcgacagatgcttgtttgcaaaatactcaattaaatgctaccgcccaaggagcacaaacctggactggcaaaaaaggagctacaactttaggcggttcaggtgacgatgcttatggagttgaaacttggacagaagctggtggagacgctactaaatttacatggtttggaccaaatcagggtggtggtttcgcttatagagcggaatggacaaattccacagattacttaggtcgctttggttatttttggggtattgacgggaaaaaatgggacaaattaggagacctttgcgttgattataactataaaagatctgccaatggcactggaggttcatattcttatataggcgtttatggatggacaaacgctggcggtggtactgaagctgaatattatatagttgaagattggtttggagaaaatcaacagactgcaaataatttaggcaatggttgccaagagcacggtgaaattacagtggacgagaaaagctataaagttgtcacttgcataagaccagcaggctctggctgcgtaacttgcaacggacaacaattcgggcaagtctttagcatacgccaaggcatgagaagcgaacaacctaaaacatgcggaacaatctccatcaaaaagcactttgaagaatgggtaaaaatgacaaccgaaaaaagcggacaatccccagctaaatatatttacgataaaacttatgaatccaaatttttagcggaggcacaaggcggcactggttggcttgaaaccactttccttaaattttctagaaacggtgattgcggcttcgatattcctgatggtcatttcacccttcaattagctacctctccgtctgagggcggtactgtaagcagaaacccaaaggaatcttcttatgcctccggttcaactgtaactctcacagccactccggcagcaggttggaaatttgccagttggagtggtgatgcatgtcaaaccacaagcccattgacagtcactatggacaaaaacaaggtaatcacagcgaaatttacccccgttgtagatctcaataaaaaccttgttacaaatggtactttcacgaataaagagagttggacttttaatactggttccagttatggcaactccgaaggaacttttgatgtgtcaaacagcgaaggcagaataaatgtgacgaaaattggctccaacccgtgggaaccacagctcgttcaaaatggcatcacccttgttgaaggaatgaattacaaaataacttttgaagcttctgcctctgctgctcgaaaaataggcttggttatacaaatggcaggcggcgattataccacttattttgaaaaagatatagacttgactgcctcaaatcaacaattttcgtatgaattcaaaatgaatgcaccaagcgatgaaagcggtcgtattgggtttaatcttgggcaaacgactggaaacgtcactctaagcaaaatcacccttcattatttagaagaagattcacacgaaccgtccgacaatccctgcgaagacccaagtccaattttgaaaaaacgcatccctgcaactcatttctcccttcaaacgcttagcgacaaagccttgcgcatagaagtgaacgctccaaccattgtggacatttttgacctgagagggaataaagttaagagtttgaatgtctccggctcgcaaacggttaaattatccctgccaagcggagtgtattttgccaaagcacgtggaatgaaaagcgtcagatttgtgttgaggtaa

SEQ ID NO: 310 - protein, 609 aa, Unknown
  Obtained from an environmental sample.
  SIGNAL (1)...(20)
MKKLTIALSLAITFAAPVFATDACLQNTQLNATAQGAQTWTGKKGATTLGGSGDDAYGVETWTEAGGDATKFTWFGPNQGGGFAYRAEWTNSTDYLGRFGYFWGIDGKKWDKLGDLCVDYNYKRSANGTGGSYSYIGVYGWTNAGGGTEAEYYIVEDWFGENQQTANNLGNGCQEHGEITVDEKSYKVVTCIRPAGSGCVTCNGQQFGQVFSIRQGMRSEQPKTCGTISIKKHFEEWVKMTTEKSGQSPAKYIYDKTYESKFLAEAQGGTGWLETTFLKFSRNGDCGFDIPDGHFTLQLATSPSEGGTVSRNPKESSYASGSTVTLTATPAAGWKFASWSGDACQTTSPLTVTMDKNKVITAKFTPVVDLNKNLVTNGTFTNKESWTFNTGSSYGNSEGTFDVSNSEGRINVTKIGSNPWEPQLVQNGITLVEGMNYKITFEASASAARKIGLVIQMAGGDYTTYFEKDIDLTASNQQFSYEFKMNAPSDESGRIGFNLGQTTGNVTLSKITLHYLEEDSHEPSDNPCEDPSPILKKRIPATHFSLQTLSDKALRIEVNAPTIVDIFDLRGNKVKSLNVSGSQTVKLSLPSGVYFAKARGMKSVRFVLR

SEQ ID NO: 311 - DNA, 3972 bp, Unknown
  Obtained from an environmental sample.
atgcggaaaagagtaatagctttatttgtaactctcatctttgtcatgtctattttaagtccaggatatcttccatttctgagtactaaagcaaatgctcaaacacaaaatacaccaacaattttaaaatttgattttgaaagcggtaatcaaggctggacggggagaggtctttcaacaactgttgcaaccgtttacaatgttgcttatgaaggtgattattcattaaaagtttctggcagaaatgcttcatgggatggagctgttattgatttaacagacaagctttcggcaaatgtgagttatacagtttctctgtttgttcgtcacagtgaccaaaaacctcaaagattttcagtatatgcatatgtaaaagattcagcaagtgaaaaatatattccagttgtagataaagttgcagttcctaattattggaagcaactggttggtaaattcacaatcaacacttcaaatccagtccaaaagattcagctgcttgtctgtgttcctacaaataaatcattggaattttttatcgatagcgtattaattgcaagtagtgcaggagcaacatctggagttgtaaaatccacaaattttgaaagcggtacaacagaaggctggcaagcaaggggaacaggttctgttgctcagattagtgttgtttctacagtagctcattcaggtagtaaaagtttgtatgtgacagggcgagttcaaacgtggcaaggtgcacaaatagatttgacaagtttgttagagaagggtaaagaatatcagttttctgtgtgggtatatcaggatagtggaagcgaccaaaagctgacactgaccatggaaaggaaaaatgcagatggaagtacaaattatgatacaataaaatggcagcaaacagtttcaagcaatacatgggtagagctaacaggttcatatacagtacctgcaacagcaacacaactaatattctacattgaatcacccaatgctaccctaagcttttatattgatgattttactgctgttgataaaaatgcaccagttgtagcgcctggaattataaaatcagccacatttgaaagcggtacaacagaagactggcaagcaagagggacaggagtgaccgtttctgttgttaacacagtggcacatactgggagcaagagtttgtatgtgacagggagaagtcaaaattggcatggtgcagaaattgatctgacaaatgtgctagagaagggcaaggaatatcaattttctgtgtgggtatatcaggatagtggaagcgatcagaagctgacattgaccatgcaaaggaaaaatgcagataacacaacagattatgattctataaaatatcagcagacagtagcaacaaatacatgggtagagctaacaggttcatatacagtgccgacaacagccacccagttaattttatatgttgaagctgcagatactaccctaagcttttatattgatgattttactgctgttgataaaaacccagaggtaataccaacagtatcgagagtaccagaatgggaaattccttcactctttgagcagtatacgaattatttcagcattggtgtggcaataccatataaagtacttacaaatccaaccgaaaaggcaatggtactcaaacatttcaacagtataacagctgagaatgaaatgaaacctgatgctattcaaaagacagaagggaattttacatttaatgttgcagaccaatacgtagattttgcacagcaaaatagaattggaatcagaggtcacactcttgtttggcatcagcaaacaccaaattggttcttccagcatagtgatggtactccgcttgatccaagcaatcctgctgacaaacaacttctacgcgatagattaagaacgcatatccaaacacttgttggaagatacgcagggaaaatttatgcatgggatgttgtaaacgaggcaattgacgagaaccagccagatggatacagaagaagtgaatggtacagaatattggggccaactgatacaacagatggcattccagaatatattctgcttgcattccagtatgcaagagaggcagacccaaatactaagctcttttataacgactataatacagaaaatccaaagaaaagacagtttatatacaatcttgttaagaagctcaaagaaagaggcttgattgatggtgtaggtctgcagtgccatattaatgtcgattcacctacagttaaagagatagaggatacaattaaactgtttagtacaatccctggcttagacattcacattacagagcttgacattagcgtttatacaagcagcagccagagatatgatactcttccacaggatataatgataaaacaggctttgaagttcaaagagctttttgagatgctaaaaagatatagctatgttgtcacaaacgttactttctggggactcaaagatgactattcatggctttcaacaagcagatctaactggccactactgtttgacaacaactaccaggcaaaatttgcatactgggcaattgttgaaccgtcagtattgccacttgctataaacaaaggatatgcaaacaatgcatcagcaaggatagatggagttttagacagagaatacaaaggtgcgattccaattaagattacaaatgaaagtggacaagaagttgcaactgttcgagctctatggaattcaagtgaactcagcctctatatatcggtcaatgatacaacaatagatgctgctaatgataaagtagttgtatttgtagaccaggataatggaaaaatgccagaaattaaacctgatgactattgggtttcaattacgagaactggtacaaaagcacaatcagctcaaggctatgtaaaggattatgctgtcgtgcagcaagcaaatggatatgtggttgagttgaagcttttaattaataacacgttaactgttaactcttctataggttttgatatagcaatctttgacaatggagttcaatacagctggaatgacaagacaaactcacagtttatagaaactgataactatggtattttaacaatggcagatagcgtcaagtttgcttctgctccaaaaggtacagcaataattgatgcagaattagatgatacatggaaaaacgctcaggaaataacaactgacacaaaggtcacggttacaggcacagtatacgactcagcttatgcaaaggctaagatgatgtgggatgaaaatagtatctatgtctatgcaattgtttatgacttgcttttgaacaaggctaatacaaatccatgggagcaggattcaattgagatatttgtggatgaaaataatcacaaaacgccttactatgaaaatgatgatgttcagtacagagtgaactatgagaatactcaaacatttggcacgaacggtgctcctcagaacttcattacagcaacaaagataattccaaacggatatatagtggaagctcaagtttacatgaggacgacaaagctttctgaaggaatggttataggctttgacattcaagtgaatgatgcagaccatacaggtaaaagagtcggtgttctaacctggaatgataaggttgggaacaattatagagacacaacaaggtttagatgcttagagcttgtagcagcacctgtaagccagccaccaatacaagctccatcaccatcacaaccaacaacaataacgtatatactaacaccgacaccaacacagccatcaacccaaacacagcagcaacctgctcagcaaccatcacagcagcaacagcaaccgcaacagcagcagcctgcacagacacaacaacctcagacacagcctgcacaaaagcctcagaatgttgtttcgataaagatagaccagacaaaagctgagacatttactgttggcgctgataccaaggttgttgtacctcaaggttctgtaactggtgcaaactga

SEQ ID NO: 312 - protein, 1323 aa, Unknown
  Obtained from an environmental sample.
  SIGNAL (1)...(33)
MRKRVIALFVTLIFVMSILSPGYLPFLSTKANAQTQNTPTILKFDFESGNQGWTGRGLSTTVATVYNVAYEGDYSLKVSGRNASWDGAVIDLTDKLSANVSYTVSLFVRHSDQKPQRFSVYAYVKDSASEKYIPVVDKVAVPNYWKQLVGKFTINTSNPVQKIQLLVCVPTNKSLEFFIDSVLIASSAGATSGVVKSTNFESGTTEGWQARGTGSVAQISVVSTVAHSGSKSLYVTGRVQTWQGAQIDLTSLLEKGKEYQFSVWVYQDSGSDQKLTLTMERKNADGSTNYDTIKWQQTVSSNTWVELTGSYTVPATATQLIFYIESPNATLSFYIDDFTAVDKNAPVVAPGIIKSATFESGTTEDWQARGTGVTVSVVNTVAHTGSKSLYVTGRSQNWHGAEIDLTNVLEKGKEYQFSVWVYQDSGSDQKLTLTMQRKNADNTTDYDSIKYQQTVATNTWVELTGSYTVPTTATQLILYVEAADTTLSFYIDDFTAVDKNPEVIPTVSRVPEWEIPSLFEQYTNYFSIGVAIPYKVLTNPTEKAMVLKHFNSITAENEMKPDAIQKTEGNFTFNVADQYVDFAQQNRIGIRGHTLVWHQQTPNWFFQHSDGTPLDPSNPADKQLLRDRLRTHIQTLVGRYAGKIYAWDVVNEAIDENQPDGYRRSEWYRILGPTDTTDGIPEYILLAFQYAREADPNTKLFYNDYNTENPKKRQFIYNLVKKLKERGLIDGVGLQCHINVDSPTVKEIEDTIKLFSTIPGLDIHITELDISVYTSSSQRYDTLPQDIMIKQALKFKELFEMLKRYSYVVTNVTFWGLKDDYSWLSTSRSNWPLLFDNNYQAKFAYWAIVEPSVLPLAINKGYANNASARIDGVLDREYKGAIPIKITNESGQEVATVRALWNSSELSLYISVNDTTIDAANDKVVVFVDQDNGKMPEIKPDDYWVSITRTGTKAQSAQGYVKDYAVVQQANGYVVELKLLINNTLTVNSSIGFDIAIFDNGVQYSWNDKTNSQFIETDNYGILTMADSVKFASAPKGTAIIDAELDDTWKNAQEITTDTKVTVTGTVYDSAYAKAKMMWDENSIYVYAIVYDLLLNKANTNPWEQDSIEIFVDENNHKTPYYENDDVQYRVNYENTQTFGTNGAPQNFITATKIIPNGYIVEAQVYMRTTKLSEGMVIGFDIQVNDADHTGKRVGVLTWNDKVGNNYRDTTRFRCLELVAAPVSQPPIQAPSPSQPTTITYILTPTPTQPSTQTQQQPAQQPSQQQQQPQQQQPAQTQQPQTQPAQKPQNVVSIKIDQTKAETFTVGADTKVVVPQGSVTGAN

SEQ ID NO: 313 - DNA, 1392 bp, Bacteria
gtgaaacgtctatccgcgctgaccgccgtcgtattgttagcgctaacaactcacgtcgccgccgctgaccccgcgccacccgccaccggccccgccatcgacttccgggccgaactccagcccatcgacggattcggcttctccatggccttccagcgggccgacctgctgcacggcgcgcgcggcctcagccccgccaagcggcgcgaggtgctcgacctgctgctcgacaaggagaggggcgcgggcctgtcgatcctgcgcctgggcatcgggtcgtcgaccgaccgggtctacgaccacatgccgacgatcctgccgaccgatcccggcgggccggacgccccgccgaagtacgtctgggacggctgggacggcggccaggtctggctcgccaaggaggccaaggcgtacggcgtcaagcggttcttcgccgacgcctggagcgcgccggccttcatgaagaccaacggcagcgagaacgacggcggcgagctccggcccgaatggcgccaggcctacgcgaactacctcgtcaagtacgcgaagttctaccaacgggaaggcatcccgatcaccgacctggggttcaccaacgaacccgactgggcggcgacctacgcctcgatgcgtttcaccccgcagcaggccgtcgacttcctcaaggtgctcgggccgaccgtccgcgcgtccggactgaagaccggcgtcgtctgctgcgacgcggcgggctgggaccggcaggtcgcctacaccgaggccatcgaggcggaccccgaggccgccaaggccgtgcggaccgtcaccggccaccgctacagcggtccgaccacggtcccgcagcccaccgacaagcgggtctggatgtcggagtggtcaccggacggcaccacctggaacgagaactgggacgacggcagcggctacgacggcctcaccgtcgccgccgacatccagaacaccctcaccgtcggcaacgccaacgcctacgtctactggaccggcgcgtccctcggcgccacccggggactcatccagctcgccaaccccggcgactcctaccgggtgtccaagcggtactgggcgctggccgccttcagccgcttcatccgccccgacgccgtccgcgtaccggtcacgaacgccgacccggccctgagcgtcacggccttccgcaacaccgacggcagccgcgtgatcgagatcctcaacacggcgaccaccgagaagtccgcccagttcgccctccgcggcggccacgaccggcaccccgagggctacgtcaccgacgagacccgctcgatcaccccggcccacgtcgcctccgcgcgcggtacgaccctcaaggccacgctcgccccgcgcgcgctgaccacgatcgtcctcgactga

SEQ ID NO: 314 - protein, 463 aa, Bacteria
  SIGNAL (1)...(22)
MKRLSALTAVVLLALTTHVAAADPAPPATGPAIDFRAELQPIDGFGFSMAFQRADLLHGARGLSPAKRREVLDLLLDKERGAGLSILRLGIGSSTDRVYDHMPTILPTDPGGPDAPPKYVWDGWDGGQVWLAKEAKAYGVKRFFADAWSAPAFMKTNGSENDGGELRPEWRQAYANYLVKYAKFYQREGIPITDLGFTNEPDWAATYASMRFTPQQAVDFLKVLGPTVRASGLKTGVVCCDAAGWDRQVAYTEAIEADPEAAKAVRTVTGHRYSGPTTVPQPTDKRVWMSEWSPDGTTWNENWDDGSGYDGLTVAADIQNTLTVGNANAYVYWTGASLGATRGLIQLANPGDSYRVSKRYWALAAFSRFIRPDAVRVPVTNADPALSVTAFRNTDGSRVIEILNTATTEKSAQFALRGGHDRHPEGYVTDETRSITPAHVASARGTTLKATLAPRALTTIVLD

SEQ ID NO: 315 - DNA, 1224 bp, Unknown; identical to SEQ ID NO: 67
  Obtained from an environmental sample.

SEQ ID NO: 316 - protein, 407 aa, Unknown; identical to SEQ ID NO: 68
  Obtained from an environmental sample.
  SIGNAL (1)...(28)

SEQ ID NO: 317 - DNA, 1695 bp, Unknown
  Obtained from an environmental sample.
gtggctggaagctcgctcacgagcaacggcctctcggccattctctcgctccagtcggactggggcagcggttactgcgcgacggtagaacttcagaacgtcggcggaactccgatcacggcgtgggaggtccaggtggagctcgctgggacgaccgtgaacagcagccacagcgcggcgttctcctcgacaggcacccgcctggtcgccaagcccttgtcctggaacgcgacgctggcacccgccgccaagacgaccttcggcttctgcgcggccgctccgagcgcagcggcgcgcccgtccgtggtgcaagtgacagcgaacggctccgccaccggaacgggcggaacgagcggcggcggcacgggcggctcgaccgctacgggcggctcgaccgctacgggcggctccggtgggtcgaccgcgggagtgtgcgcggcaacctacgaggccgagagcatgctccacagcaccggcaacgccatcagcggcggctggaacatctattcgaacggcaacatcaccgccacgcactccttcgcagccggctcgaatcgactcaccgtgcacgccaagggcgaccaggccaacggggcgcccatcatgcgcgtcagcgtgggcaacaccgtcgtcggcgaggtgccagtgccggtgaccgtgtggacaccgtactgcttcgactacgccgcggcgagcgcaggcgcgcagaccgtcaagatcgagttcacgaacgactacaatggcggcaccggcgccgaccgcaatctgcacgtggacaaggtcgcggtgcagtgcggcgcgagctgcaacagcgggagcggagggggcaccggcggctcgagcggaagcggcggcacctcggccaccggcggctccgccagcggtggcgcggcagggacgacctgcacgaacgttcgtcccactggaaccgactgggacgcggcgacctgcgacatgtgggcctcgcaaactagcgagtgcagcgcggcctggatgatcgacaaccattactgcgaccagagctgcgggcgctgctcgggcgggagcgggaccggtggcacgaacacgggaggcaccggcggtggagtgaccccgagtacctgcacggagcccaattctcagcagtgctccacctacaaggtcgggactcactgcggcctcacctacgagatctggaccgacggctccgcgggctgcatgacgaacacctcctacgggttcctcgccaattggagccaggggaacgcaaactacctggctcgcaagggcgttcggcccggctcgtcgcgaccggtcgtgacgtacagcgcgaactaccagccgaacgggaattcctacctggggatctacggttggacgcagaacccgctcgtcgagtactacatcatcgatagctgggggagctggcgtccaccggggacccaggcgatgggcaccgtccaggtggacggcgggacctacgatatctaccggagcgagcgggtgaacaagccctcgatcgagggcaacaagaccttctggcagtactggagcgtccgcacccagaagcgcaccagtgggaccatcaccgtggctccgcacttcgccgcgtgggcggcatccggactgcagatgggctccttctacgaggtctccctggtggtggagggctacaacagctccggcagcgccgacgtaacggtgtcgttccggtag

SEQ ID NO: 318 - protein, 564 aa, Unknown
  Obtained from an environmental sample.
MAGSSLTSNGLSAILSLQSDWGSGYCATVELQNVGGTPITAWEVQVELAGTTVNSSHSAAFSSTGTRLVAKPLSWNATLAPAAKTTFGFCAAAPSAAARPSVVQVTANGSATGTGGTSGGGTGGSTATGGSTATGGSGGSTAGVCAATYEAESMLHSTGNAISGGWNIYSNGNITATHSFAAGSNRLTVHAKGDQANGAPIMRVSVGNTVVGEVPVPVTVWTPYCFDYAAASAGAQTVKIEFTNDYNGGTGADRNLHVDKVAVQCGASCNSGSGGGTGGSSGSGGTSATGGSASGGAAGTTCTNVRPTGTDWDAATCDMWASQTSECSAAWMIDNHYCDQSCGRCSGGSGTGGTNTGGTGGGVTPSTCTEPNSQQCSTYKVGTHCGLTYEIWTDGSAGCMTNTSYGFLANWSQGNANYLARKGVRPGSSRPVVTYSANYQPNGNSYLGIYGWTQNPLVEYYIIDSWGSWRPPGTQAMGTVQVDGGTYDIYRSERVNKPSIEGNKTFWQYWSVRTQKRTSGTITVAPHFAAWAASGLQMGSFYEVSLVVEGYNSSGSADVTVSFR

SEQ ID NO: 319 - DNA, 1095 bp, Unknown
  Obtained from an environmental sample.
atgaaggtgacccgaacagctgtcgcgggcattgtcgccgcagcggtcctcatcacgatcggcacgtcgaccgcgtcggctgaggatgaaccaaccagcgagaacacgtcgacggatcagccgttgcgcgtcctggcagccaaagccgggatcgcgttcggcacggccgtcgacatgaacgcgtacaacaacgacgcgacctaccgtgagctcgtcggccaggagttctcgagcgtcacggccgagaacgtcatgaagtggcagctcctcgagccgcagcgaggggtctacaactggggtccggccgatcagctcgtgcgcgtagccaacgagaacggccagaaggtgcgcgggcacacgctcatctggcacaaccagctgcccacctggcttaccagcggagtcgcctccggtgagatcacaccggacgagctccggcagctcctgaggaaccacatcttcacggtgatgcgccacttcaagggcgagatccaccagtgggatgtcgccaacgaggtcatcgacgacagcggcaacctgcgcaacacgatctggctgcagaacctgggtccgagctacatcgcggacgcgttccggtgggctcgcaaggccgacccggacgccgccctctatctgaacgactacaacgtcgagggcccgaacgccaaggccgatgcgtactacgccctggtcaagcagctcctcgccgacgacgtgccggtggacggcttcggaatacaggggcacctcggtgtgcagttcggcttctggcccgcgagtgcggtggccgacaacatggggcgcttcgaggcactcggcctgcagacggcggtcaccgaggcggatgtccggatgatcatgccgcccgacgaggacaagctggccgcacaggcacgtggctacagcacgttggtccagggctgcctgatggccaagcgttgcaggtcgttcaccgtctggggcttcaccgacaagtactcctgggttccgggcaccttccccggccagggcgcggcgaacctcctggccgaggacttccagcccaagccggcttactacgccgtccaggatgacctcgcgcgcgccggacggtag

SEQ ID NO: 320 - protein, 364 aa, Unknown
  Obtained from an environmental sample.
  SIGNAL (1)...(27)
MKVTRTAVAGIVAAAVLITIGTSTASAEDEPTSENTSTDQPLRVLAAKAGIAFGTAVDMNAYNNDATYRELVGQEFSSVTAENVMKWQLLEPQRGVYNWGPADQLVRVANENGQKVRGHTLIWHNQLPTWLTSGVASGEITPDELRQLLRNHIFTVMRHFKGEIHQWDVANEVIDDSGNLRNTIWLQNLGPSYIADAFRWARKADPDAALYLNDYNVEGPNAKADAYYALVKQLLADDVPVDGFGIQGHLGVQFGFWPASAVADNMGRFEALGLQTAVTEADVRMIMPPDEDKLAAQARGYSTLVQGCLMAKRCRSFTVWGFTDKYSWVPGTFPGQGAANLLAEDFQPKPAYYAVQDDLARAGR

SEQ ID NO: 321 - DNA, 1608 bp, Unknown
  Obtained from an environmental sample.
gtggactggtgggacgtggatattttttccgcgaaggaaatcacccacccgcaactggcaaccttcctggatgcctcacgagaccatcgcaagccggtcatgatcggcgagatgaccccacgccacgtcggcgtgatcgaggggcagaaatgctgggatgaatggtttggcccgatgattgatctgctcaaacgtcgccccgaaatcaaggccacggcctatatcaactgggaatggcgcgagtggtccgaccgcctcggcttccgctggcacaactggggcgacgcccgcatcgagggcaacgcccttgttcgtgatcgctgggtgcaggaactctcccaccccatctatctccacgcggcgcgcgacggatcttgtccgctgccgccaatcaccgccctcccatccgcgaccccgtcgctccagaccgtgttccaggaccatttcctgatgggtgctgccttgaatgtgaggcagttcaccgaaaacgacgcaaccaagaccgctctcatcaagaagcaattcaacaccatcacgcccgagaatgttctcaagtgggggccggttcatcctgagcccaaccggttcaacttcgaatccaccgatcgttacgtggactttggtgtgaagaaccggatgttcatcgtcggccacaccctcgtctggcaccaccagacacccgcctgggtgtttcaagattcccaaggccagccgctcgaccgggatggactgctcaatcgcttgagcaaccacatccacacggtggttggacgctacaagggccgcatccacgggtgggatatggtgaacgaggccttgaacgatgacggcaccctccgccctagccaatggcttaaaatcatcggccccgactacattgccaaagcgtttgcccttgcccacgccgccgaccctgccgctgaactgtattacaacgattacagtctcgatcatcccgccaagtgtgctggtgcgatcgcgctggtgaagcagctccagacgaatggcatatccattgccgggattggcacgcagacccacgtcggactcaacggaccttccccccagtcggtggatgattcattgacggcctttggccagctcggcgtgaaggtcatggttaccgaactcgacgttgatgtgctgcccgccgccagccaaaatcaaaacgcggatctcaaccagcccgccttgtccaatcccgccctcaatcccgccctcaatccctatcccgatgggctgccgcaagccgtccaggacaaactggccgctcgctatgcggaactcttcgccgtgttcgtcaagcacgccgacaaaatcagccgcgtcacgttctggtgcgtcaccgacggcgactcctggctgaacaactggcccgtgcgtggccgcgtcaactatccgctgctgttcgaccgtgccagccagcccaagcccgccttcgatgcggtcattcgcgtcgccaaggacccgccgacggtttcgcacaatctcaccccgctccacgatgcggcgcgggtcctggtcaatccgcacaagggctggtaccaccactacccggacaatcacatcaacaagtatgagatcgcccgcgatgccgacctgacggaa

SEQ ID NO: 322 - protein, 536 aa, Unknown
  Obtained from an environmental sample.
MDWWDVDIFSAKEITHPQLATFLDASRDHRKPVMIGEMTPRHVGVIEGQKCWDEWFGPMIDLLKRRPEIKATAYINWEWREWSDRLGFRWHNWGDARIEGNALVRDRWVQELSHPIYLHAARDGSCPLPPITALPSATPSLQTVFQDHFLMGAALNVRQFTENDATKTALIKKQFNTITPENVLKWGPVHPEPNRFNFESTDRYVDFGVKNRMFIVGHTLVWHHQTPAWVFQDSQGQPLDRDGLLNRLSNHIHTVVGRYKGRIHGWDMVNEALNDDGTLRPSQWLKIIGPDYIAKAFALAHAADPAAELYYNDYSLDHPAKCAGAIALVKQLQTNGISIAGIGTQTHVGLNGPSPQSVDDSLTAFGQLGVKVMVTELDVDVLPAASQNQNADLNQPALSNPALNPALNPYPDGLPQAVQDKLAARYAELFAVFVKHADKISRVTFWCVTDGDSWLNNWPVRGRVNYPLLFDRASQPKPAFDAVIRVAKDPPTVSHNLTPLHDAARVLVNPHKGWYHHYPDNHINKYEIARDADLTE

SEQ ID NO: 323 - DNA, 2355 bp, Unknown
  Obtained from an environmental sample.
atgatgctcaatgcccgttgtatccaacttatgaagttgttgcttcgctcttctctttatcttaccgctgacaaattggcgcaatcattgaatgtatccaagcgaacgatttattacgatatacaaaaaacgaatgaatggttgcatcatgaagggctgaagccgattcaatatgcgcgcgggctcggatttcgcttggatgatgaagtgaaacaagaaataacaacaaagtggaacacattacaacctgcccgacattacacatatcagtcatgggagcgaaaagcttggattggtttatggattttgactcgcgttcatccactgtatttgtctgattttttagagaaattacatgtaagcaggagcacgttgttaaatgacataaaggaactgaaagaagattggcagtcatttcagttgcgattgtcattccatcgcaaaaaagggtatttttcatcaggggaagaaatccaaaaaaggaaattgatgattcgttatattcatcaaatattagcggcgatggatgaccagcatttcgctgcagaattgtcagctgagtgtcaatggccaatctttgattggatttgccaattcgagtctactttttctattcgctataccggtgaggttattcaaactttacctatttacctcgcattgttccaaagacggtgggctagaggcaaatttgtgcaaatggacgagcaagaaaaagaagtgctaaggtcaatgcgggaataccagattgctgatcatctcgttagacgaattgaaaacgtttccgaaatatctattcccgatgacgaggtttgttatttgacgacccatttactcagttttcgagttgcagatgacaagcaaatcgatcataacgatgacatcactactttgaaacgaatcattcgacatatggtggatgattttcaaacttatgcctgtgtacaattcaagcgtcgcgaagagttggaaaaaaatttattggttcatatgaagcctgcctattatcgactgaaatacggttttcatctgcaaaacgatctgaccgaatcggtcaaagcgaactatcaagatttatttaccttaacgaaaaaagtcgtccatcatttagaaagtgtagttggccagccggtcagcgacgatgaaattgcttatatcgccatgcattttggcggatggttggacagagagggggtgtcggttccagtacggaaaaaggtgttgatcgtctgcgagagcgggattggaacatcgcgaatgttgcaaaaacaattggatcaacgctacaaaaacgagttcacgattggtgcggcagtagaaccttatcaactacaaaatgaaaaagacgtacaaatgctaaagcgccacttcaacagcattgttgccgagaacgtaatgaaaccgatcagcattcaacctgaggaaggaaaattcaattttgaacaagcggatcgaattgtgaagttcgctaaggcaaatggcatggatattcgcttccatacactcgtttggcacagccaagtacctcaatggttctttcttgacaaggaaggcaagccaatggttaatgaaacagatccagtgaaacgtgaacaaaataaacaactgctgttaaaacgacttgaaactcatattaaaacgatcgtcgagcggtacaaagatgacattaagtactgggacgttgtaaatgaggttgtgggggacgacggaaaactgcgcaactctccatggtatcaaatcgccggcatcgattatattaaagtggcattccaaacagcgagaaaatatggcggcaacaagattaaactttatatcaatgattacaataccgaagtggaaccaaagcgaagcgctctttataacttggtgaagcaattaaaagaagagggcgttcctattgacggcatcggccatcaatcccacattcaaatcggctggccttctgaagcagaaatcgagaaaacgattaacatgttcgccgctctcggcttagacaaccaaatcactgagcttgatgtgagcatgtacggttggccgccgcgcgcttacccgacgtatgacgccattccaaaacaaaagtttttggatcaggcagcgcgctatgatcgtttgttcaaactgtatgaaaagttgagcgataaaattagcaacgtcaccttctggggcatcgccgacaatcatacgtggctcgacagccgtgcggatgtgtactatgacgccaacgggaatgttgtggttgacccgaacgctccgtacgcaaaagtggaaaaagggaaaggaaaagatgcgccgttcgtttttggaccggattacaaagtcaaacccgcatattgggctattatcgaccacaaatag

SEQ ID NO: 324 - protein, 784 aa, Unknown
  Obtained from an environmental sample.
MMLNARCIQLMKLLLRSSLYLTADKLAQSLNVSKRTIYYDIQKTNEWLHHEGLKPIQYARGLGFRLDDEVKQEITTKWNTLQPARHYTYQSWERKAWIGLWILTRVHPLYLSDFLEKLHVSRSTLLNDIKELKEDWQSFQLRLSFHRKKGYFSSGEEIQKRKLMIRYIHQILAAMDDQHFAAELSAECQWPIFDWICQFESTFSIRYTGEVIQTLPIYLALFQRRWARGKFVQMDEQEKEVLRSMREYQIADHLVRRIENVSEISIPDDEVCYLTTHLLSFRVADDKQIDHNDDITTLKRIIRHMVDDFQTYACVQFKRREELEKNLLVHMKPAYYRLKYGFHLQNDLTESVKANYQDLFTLTKKVVHHLESVVGQPVSDDEIAYIAMHFGGWLDREGVSVPVRKKVLIVCESGIGTSRMLQKQLDQRYKNEFTIGAAVEPYQLQNEKDVQMLKRHFNSIVAENVMKPISIQPEEGKFNFEQADRIVKFAKANGMDIRFHTLVWHSQVPQWFFLDKEGKPMVNETDPVKREQNKQLLLKRLETHIKTIVERYKDDIKYWDVVNEVVGDDGKLRNSPWYQIAGIDYIKVAFQTARKYGGNKIKLYINDYNTEVEPKRSALYNLVKQLKEEGVPIDGIGHQSHIQIGWPSEAEIEKTINMFAALGLDNQITELDVSMYGWPPRAYPTYDAIPKQKFLDQAARYDRLFKLYEKLSDKISNVTFWGIADNHTWLDSRADVYYDANGNVVVDPNAPYAKVEKGKGKDAPFVFGPDYKVKPAYWAIIDHK

SEQ ID NO: 325 - DNA, 1146 bp, Unknown
  Obtained from an environmental sample.
atgactatttcccgccggaaatttatgtggggcacagctgcactcctggccaccacccagctcaaaacccgcgctctcgccgctgccatggccagcacaggcatcaaggacgccttcaagggcgacttccatatcggcaccgccatcagcaacgctaccctgcaaaaccaggatgccaccatgctggatttgatcaagcgcgaatttaatgcaattaccgctgaaaattgcatgaagtgggagcctattcgcccacagctggatcagtggaattgggagctggccgaccgctttgtggatttcggcgttaaaaacaagatgtatgtggtaggtcacacgctgatttggcacagccaggcgccagcgcacatttatctcgacgccgatggtaagcccaacagtcgcgatgcccagttgaaagtaatggaggagcacatacgtaccctggcgggccgctacaaaggaaagatagacgcctgggacgtggttaacgaagcagtggaggatgatggcagctggcgtcaaaccggctggtacaaaaacatgggtgaagaatatatcgcccatgccttccgcttggcagccgaggtagaccccaacgccaagctactctacaacgactacaacgaggctgtacccgccaagcgtgatgcgattattcgggtggtaaaaggcgtgcagaaggctggcgcacccattcacggtgtggggatgcaagggcacatgagcctgtcacatccggatttcgcggagttcgaaaaatccataatcgaatacgccaagttgggggtgaaggtgcacgttaccgaactggatatcgacgtgttgccactggcgtggaacctgagtgcggaaatttccaatcgctttgaataccgcccagagatggatccttatcgcgaaggtttgcccgccaaagtcgaggaggagctagcggctcgttacgaggcgctgtttaaaatcctgctgcgtcatcgcgacaaaattgagcgtgtgaccacttggggcaccaacgactcagagacctggttaaatggcttccccattccggggcgcatgaattacccaatgctgttcgatcgtaataaccagcccaagttggcctatcaccggctgctggcactcaaacaaaagaaaagtcagtaa

SEQ ID NO: 326 - protein, 381 aa, Unknown
  Obtained from an environmental sample.
  SIGNAL (1)...(27)
MTISRRKFMWGTAALLATTQLKTRALAAAMASTGIKDAFKGDFHIGTAISNATLQNQDATMLDLIKREFNAITAENCMKWEPIRPQLDQWNWELADRFVDFGVKNKMYVVGHTLIWHSQAPAHIYLDADGKPNSRDAQLKVMEEHIRTLAGRYKGKIDAWDVVNEAVEDDGSWRQTGWYKNMGEEYIAHAFRLAAEVDPNAKLLYNDYNEAVPAKRDAIIRVVKGVQKAGAPIHGVGMQGHMSLSHPDFAEFEKSIIEYAKLGVKVHVTELDIDVLPLAWNLSAEISNRFEYRPEMDPYREGLPAKVEEELAARYEALFKILLRHRDKIERVTTWGTNDSETWLNGFPIPGRMNYPMLFDRNNQPKLAYHRLLALKQKKSQ

SEQ ID NO: 327 - DNA, 1500 bp, Unknown
  Obtained from an environmental sample.
atgaaacgttcagtctctatctttatcgcatgtttagtaatgacagtattaacaattagcggtgtcgcggcaccagaagcatctgcagcaggggcgaaaacgcctgtagcccttaatggccagcttagcattaaaggtactcagctagtcaatcaaaacggaaaatcggtgcagctgaaggggatcagctcacacggtttgcagtggttcggcgattatgtcaataaagactctttaaaatggctaagagacgattggggaattaccgtcttccgagcggcaatgtacacggctgaaggcggttatatagagaatccgtctgtgaaaaataaagtcaaagaagctgttgaagcggcaaaagagctcgggatatatgtcatcattgactggcatattttaaatgacggcaatccaaatcaaaataaagagaaggcgaaggaattctttaaggaaatgtcgagcctttacggaagcacaccaaacgttatttatgaaattgctaatgaaccgaacggtgatgtaaattggaagcgcgatatcaaaccgtatgcggaggaagtgatttccgttatccgtaaaaatgacccggataacatcattattaccggaactggcacttggagtcaggatgtcaatgatgctgctgatgatcagcttaaggatgcaaacgtcatgtacgcgcttcatttttatgcaggtacacacggccagtatttaagggataaagccgattatgcgctcagcaaaggagcgccgatttttgtaacggaatgggggacgagtgacgcttccggaaatggcggggtcttccttgaccagtcgagggaatggctgaattatctcgacaacaagaaaatcagctgggtaaactggaacctttctgataagcaggaatcttcctcagctttaaagccgggggcatctaaaacaggcggctggccgttatcagatttatccgcttcagggacatttgtaagggaaaagatccgtggctcccaacattcgactgaagacagatctgagacaccaaagcaagataaacccgtacaggaaaacagcctatctgtgcaatacagaacaggggatggaagtgtgaacagcaaccaaatccgtcctcagatccatgtgaaaaacaacagcaagaccaccgttaatttaaaaaatgtaactgtccgctactggtataacacgaaaaacaaaggccaaaacttcgactgtgactacgcgaagatcggatgcagcaatgtgacgcacaagtttgtgacattacaaaaacctgtaaaaggtgcagatgcctatctggaacttgggtttaaaaacgggacactgtcaccgggagcaaacactggagaaatccaaattcgtcttcacaatgaggattggggcaattattcacaaatcggggattattctttttctcagtcaaatacgtttaaagatacaaaaaaaatcacattatataataacggaaaactaatttggggaactgaacccaaatag

SEQ ID NO: 328 - protein, 499 aa, Unknown
  Obtained from an environmental sample.
  SIGNAL (1)...(29)
MKRSVSIFIACLVMTVLTISGVAAPEASAAGAKTPVALNGQLSIKGTQLVNQNGKSVQLKGISSHGLQWFGDYVNKDSLKWLRDDWGITVFRAAMYTAEGGYIENPSVKNKVKEAVEAAKELGIYVIIDWHILNDGNPNQNKEKAKEFFKEMSSLYGSTPNVIYEIANEPNGDVNWKRDIKPYAEEVISVIRKNDPDNIIITGTGTWSQDVNDAADDQLKDANVMYALHFYAGTHGQYLRDKADYALSKGAPIFVTEWGTSDASGNGGVFLDQSREWLNYLDNKKISWVNWNLSDKQESSSALKPGASKTGGWPLSDLSASGTFVREKIRGSQHSTEDRSETPKQDKPVQENSLSVQYRTGDGSVNSNQIRPQIHVKNNSKTTVNLKNVTVRYWYNTKNKGQNFDCDYAKIGCSNVTHKFVTLQKPVKGADAYLELGFKNGTLSPGANTGEIQIRLHNEDWGNYSQIGDYSFSQSNTFKDTKKITLYNNGKLIWGTEPK

SEQ ID NO: 329 - DNA, 2268 bp, Unknown
  Obtained from an environmental sample.
atgaggaacgttcaggaaataggaggcagtatgtacaaaaaggcttttcttgtactggcattgtttttgctgttggcggcggtggcgctcccgtctgtgggggctgcgccgcaggggccgcgcctgcgcgatgtggcgggcgacattttagtgggttacgcctccagaaacgatttctggaacatgtctgactcagcccaatacacagaagttgcccgcactgagttcaacttcatgacgcccgaaaacgccatgaagtgggacgccattcatcccgcgcaaaactcatacagttttgcccaggccgaccggcacgtgcagtttgcccaggccaacaacatggccgtgcatggacatgccctcgtgtggcacagccaaaatccaggctggctgaccaatggcaactggtcccgcagccaattgatcaacatcatgaacgaccacattgacacggtcgccggccgttatgcaggtgaggtgctggtgtgggacgtggtcaatcaggcgtttaatgaggatggaacttatcgcagcaccatctggtacaacgggatcggacaggaatatatcgacctggcctttacccgcgcccgcgccgccgatcctcatgccaaactcatttacaacgattacaacattggctggttaaacagtaagtcgaatggcgtctacaacatggccgccgatatggtcaggcgcggtgtgcccatcgacggcgttggtttccagatgcacctggaacggggcggcgtcagcggcagcagtctggcgagcaacatgcagcgtttcgccgatttgggattggaagtttacatcaccgaattggacgtgcgcattccccaaaacccaacccagcaggatttgcaggctcaggcggcagtttaccaaacggtgacgaatcgctgtttggcgcagcctgcctgcaaggcgttgcaggtctggggcatccccgacaaatattcctgggtaccggacgtattccccggcacgggcgcgcctctgttgtttaacgacaactatgaggccaaacccgcctattatgccgtccaggcagagttgatggccgcgaatccgcagcccacaaacacaccgggaacgcccgctcataccccttcggccacgtctacgtctgcggccactgctacgcccccggcaacggccacggcgaccgccaccaccccctccggcggcggcgtttgcgccgttgattacgtcattgccaaccagtggggcaatggctttcaggccaacgtcaccatcaccaatcacagcgccgcgccggtgaacggctataccctggcctggacccacgcgccggggcagattgtcaccagcggctggaacgtaaccatcgcccaaagcggcagcgccgtcagcgccagcaacccggccggttattggaacggtgtgatcggagccaacggcggcaagatttcttttggtttccagggatctctggcgggcggcagcgcggtcgcgcccacttattttgccttgaacggcgctgcctgtaacggggccgtccttccgcctactgccaccttcacgccttcaccgacggctaccatgtgtccccaggcaacgcctgaactgcttgtcgtgcagccggtgacttcacccactacccaactgtctcaaacgctggtggtgcgtttaggcaacggcgaatgggtgcgcgctgccggaccggcaggcgttgtcaccgtcactgcgccggacccggatggttatttccgcctgacgataccgctggcagccaataccagcaacgccattctggtagaagggcgggtgcgggttatcacccattcaaatggctgcacctatggcggttataccttgagcagaaccgtaacgattgtgcaagccagcagcccagtcaccttaacgccgactgccacaccttcccccaccgccacggcaacgcctacggtaaccgccacgtcgccgtcaggcgcctgcaccgtcgcctacgccatcaccaacgactggggcagcggtttcaccgccaacgttaccctcaccaatactggcggaagcgccctcaacggctggaccctggcctatgcctttcccggcaatcaaaccatcagcaacgcctggaacggaacggccgttcagtccggcagcagcgtcagcgtcaccaacgccggttggaatggcagcctgccgcccaacgtctccgccagctttggcttccaggcgagctacagcggcaataacagcgtccctgccagctttacgctgaacggcgcgctttgccattga

SEQ ID NO: 330 - protein, 755 aa, Unknown
  Obtained from an environmental sample.
  SIGNAL (1)...(35)
MRNVQEIGGSMYKKAFLVLALFLLLAAVALPSVGAAPQGPRLRDVAGDILVGYASRNDFWNMSDSAQYTEVARTEFNFMTPENAMKWDAIHPAQNSYSFAQADRHVQFAQANNMAVHGHALVWHSQNPGWLTNGNWSRSQLINIMNDHIDTVAGRYAGEVLVWDVVNQAFNEDGTYRSTIWYNGIGQEYIDLAFTRARAADPHAKLIYNDYNIGWLNSKSNGVYNMAADMVRRGVPIDGVGFQMHLERGGVSGSSLASNMQRFADLGLEVYITELDVRIPQNPTQQDLQAQAAVYQTVTNRCLAQPACKALQVWGIPDKYSWVPDVFPGTGAPLLFNDNYEAKPAYYAVQAELMAANPQPTNTPGTPAHTPSATSTSAATATPPATATATATTPSGGGVCAVDYVIANQWGNGFQANVTITNHSAAPVNGYTLAWTHAPGQIVTSGWNVTIAQSGSAVSASNPAGYWNGVIGANGGKISFGFQGSLAGGSAVAPTYFALNGAACNGAVLPPTATFTPSPTATMCPQATPELLVVQPVTSPTTQLSQTLVVRLGNGEWVRAAGPAGVVTVTAPDPDGYFRLTIPLAANTSNAILVEGRVRVITHSNGCTYGGYTLSRTVTIVQASSPVTLTPTATPSPTATATPTVTATSPSGACTVAYAITNDWGSGFTANVTLTNTGGSALNGWTLAYAFPGNQTISNAWNGTAVQSGSSVSVTNAGWNGSLPPNVSASFGFQASYSGNNSVPASFTLNGALCH

SEQ ID NO: 331 - DNA, 1242 bp, Unknown
  Obtained from an environmental sample.
gtgttcaagggcttgcgctatttgctgttgctgtgcctgagtgcgggactggtctttgcctgtgcgccacggtctgtgaccgccccacccgatgggctaagcgggcaaattaggctcctgcgccaaggaaccctcactgtccttgtccagaatgcccaagggcaacccattgccaacgccaaggtggtagctgctcagcaaacccatgccttcccctttggtgttgccttagatacagcaatgtttgagccttccccgccacccgcagccaactggtaccgcaacaccgctcgccaaaattttaatgccgctgtccatgaaaacgccctcaagtggtatgcccttgaaccggagcagggcaagctggactttacgatggcggatcgcatcctcgcttggagtgaagcccaaggctggccgatgcgggggcacaccctcttttgggaagttgagcaatttaaccccccatggctgaaaacgctgccaccagagcaactgcgggctgccgtcaagaaccatgccatgacggtgtgtcgccattaccgcgggcgaatcaatgaatttgatgtcaataatgaaatgctccacggtaactttttccgcagtcgtttgggaaacggcatagttaaagagatgttcgagtggtgccgcgagggtaaccccgaggccgtcctttatgtgaacgactacggcattattgagggcgatcgcctcgacgactacgtgcagcagattcgcgatttactggggcaaggggttcccattggtggcattggcattcaagcccatttggaatatcccttggatgcagccaagatgaaacgcgcccttgatacccttgcccaattcaacctgcccctaaaaatcactgaagttagtgtcagccttgccgacgagcagcagcaggcggagacactgcgccaaatctaccgcattggttttgcccatccagccgtcaaagagatcctcctgtggggattttgggaaggcaaccactggcgaccccaagcaggactgtaccgtcgcgacttttccgccaaacctgctgccgaagcctatcgacaactcctctttcaggagtggtggaccaccagcaacggcaaaactaatgccgatgggcgctggcagacccgcggctatgcggggcgctatcgcctcacagtaacggccaacggccagaccattaaccgcgacattgacctaccagacttggagagaaccgtgaccgtacaattcccatga

SEQ ID NO: 332 - protein, 413 aa, Unknown
  Obtained from an environmental sample.
  SIGNAL (1)...(28)
MFKGLRYLLLLCLSAGLVFACAPRSVTAPPDGLSGQIRLLRQGTLTVLVQNAQGQPIANAKVVAAQQTHAFPFGVALDTAMFEPSPPPAANWYRNTARQNFNAAVHENALKWYALEPEQGKLDFTMADRILAWSEAQGWPMRGHTLFWEVEQFNPPWLKTLPPEQLRAAVKNHAMTVCRHYRGRINEFDVNNEMLHGNFFRSRLGNGIVKEMFEWCREGNPEAVLYVNDYGIIEGDRLDDYVQQIRDLLGQGVPIGGIGIQAHLEYPLDAAKMKRALDTLAQFNLPLKITEVSVSLADEQQQAETLRQIYRIGFAHPAVKEILLWGFWEGNHWRPQAGLYRRDFSAKPAAEAYRQLLFQEWWTTSNGKTNADGRWQTRGYAGRYRLTVTANGQTINRDIDLPDLERTVTVQFP

SEQ ID NO: 333 - DNA, 1152 bp, Unknown
  Obtained from an environmental sample.
atgaaaagacaatttattggacgattgagacttgtcactatcctttcaatcatagtgattatgggatgtgcttcaaacaaaagtgatcagaatgttgataacctaaaggacgccttcgacggtttgttccttattggaactgccatgaataccccccagatcaccggacaggatacccggacgcttgaattgatcaaaaaacacatgaactccattgtggcagaaaacgttatgaaaagcggactaatacagcccagcgaaggggagttcgacttctcacttgccgaccagtttgtgcaattcggtgttgacaacaacatgcacatcgtagggcatacccttatctggcattcgcaggctccagggtggttttttgtggatgaaaacggtaatgatgttagtcccgaagttcttaagcaaaggatgaaagaccacatctacacagtagttggccgttacaaaggcaaagtgcacggttgggatgtggtgaatgaatgtatcgttgacgatgggtcatggcgcaacagcaagttttaccagatcctgggtgaagactttgtaaagtatgccttccagtttgcttcagaagccgacccgaatgctgaattgtattacaacgattattccatggcacttcccggccgccgccagggagtcgtaaacatggtaaaaaatctacaggcacaaggtattaaaattgacggaataggaatgcagggccacctgatgatcgaccatccatcccttgaagatttcgaaaccagtttgcttgcctttgccgatctgggtgtacatgttatgatcactgagcttgatgtatctgtacttccttttcctacccgcaacctcggtgctgatgtatctctaaacatagcttacaacactgaactgaacccctatcccgatggattgcctgatgatgtggcccaaaaacttcatgatcgctggctcgatatatatcgtttatttataaaacatcacgacaagatcacccgtgttactacctggggtacagccgatggtatgtcatggaagaacaactggcccattcgtggacgcacagactttcctttattattcgaccgcgattttcaacccaaaccggtagtagctgatattatcaaagaagcattggctgcaaagagaaaatag

SEQ ID NO: 334 - protein, 383 aa, Unknown
  Obtained from an environmental sample.
  SIGNAL (1)...(30)
MKRQFIGRLRLVTILSIIVIMGCASNKSDQNVDNLKDAFDGLFLIGTAMNTPQITGQDTRTLELIKKHMNSIVAENVMKSGLIQPSEGEFDFSLADQFVQFGVDNNMHIVGHTLIWHSQAPGWFFVDENGNDVSPEVLKQRMKDHIYTVVGRYKGKVHGWDVVNECIVDDGSWRNSKFYQILGEDFVKYAFQFASEADPNAELYYNDYSMALPGRRQGVVNMVKNLQAQGIKIDGIGMQGHLMIDHPSLEDFETSLLAFADLGVHVMITELDVSVLPFPTRNLGADVSLNIAYNTELNPYPDGLPDDVAQKLHDRWLDIYRLFIKHHDKITRVTTWGTADGMSWKNNWPIRGRTDFPLLFDRDFQPKPVVADIIKEALAAKRK

SEQ ID NO: 335 - DNA, 849 bp, Unknown
  Obtained from an environmental sample.
atgattccaaggatcgtcctggccgtccgcatatcccctacttttctcagcccacaaaaaggggtaataaaaatgataaagcgggcttttatgataaccctggcggccttcctcctccttttcgccctaaattccctgcctatccatgccggggccgaaggcggggaggaaaagtttacccccaaggtcatcgtggagcacggtttcgagaataacgacttccacggttgggtcccccggggcggggtcgggaccatttccattaccaatgaggcggcccatagcgggtcctcctgcctgaagatcaccggccggactcaagcttggcatatgccgcgggtggagatcaccaagtacttagaaaagggagctaagtataagatcgaattgtacgtcaagctccccgcgggcacctcgccgcgcaagttccagctggcggttctcacccgttatctcgaaggcaaccagaccagggacaaagaggactccatctcggacgaggtggaggtgaccgccgatacctggaccaaggtcgagggcgagtacgtcttcgacccggcggccatcggcgcctacgtctacccctacctcaagggcgaccccgcaggggcctatgccccctatctcatcgatgatttcaagatcaccacgatcgcccccgcccccaagaagaccgccgctaccgccgcggcaaaagaggcagaagagcccttaatcgagaccgatataccatccttaaaagacgtctgcgcgtcctacttcgagatcggcgcggccatcgagccatatgagttattctccaagccccacgatcagctgctccggaaacatttcaacaccgttggttga

SEQ ID NO: 336 - protein, 282 aa, Unknown
  Obtained from an environmental sample.
  SIGNAL (1)...(50)
MIPRIVLAVRISPTFLSPQKGVIKMIKRAFMITLAAFLLLFALNSLPIHAGAEGGEEKFTPKVIVEHGFENNDFHGWVPRGGVGTISITNEAAHSGSSCLKITGRTQAWHMPRVEITKYLEKGAKYKIELYVKLPAGTSPRKFQLAVLTRYLEGNQTRDKEDSISDEVEVTADTWTKVEGEYVFDPAAIGAYVYPYLKGDPAGAYAPYLIDDFKITTIAPAPKKTAATAAAKEAEEPLIETDIPSLKDVCASYFEIGAAIEPYELFSKPHDQLLRKHFNTVG

SEQ ID NO: 337 - DNA, 870 bp, Unknown
  Obtained from an environmental sample.
atgaagcccgacagcgtgctggatgtaaacgccagcaaaaagctctccgcccaggatgaaaccgccgtggcggtgaaattcgacgccgcccgcgccctgctggattttgtcaaggaaaacgggctcaaggtgcacggtcacgtgctggtatggcattcccagacgccggaagccttcttccacgagggctatgatgccgccaggccctacgtggggcgggacgtgatgctggggcgcatgaaaaactacatcaaggccgtgtttgaatacactgagaccaattaccccggcgtcatcgtctcctgggacgtagtgaacgaagccatcgacgacggcaccaacaagctgcgccagtccaactggttcaaaaccgttggcgaggatttcgtgctccgcgcctttgaatacgccaggaaatacgcccccgaaggcacgctgctttattacaacgattacaacaccgccatgcccggcaagctgaacggcatcgccaatctgctcaaagccctcatcgccgagggcaacatcgacggctacggcttccaaatgcaccacagcgtgggcttcccctccatggaaatgatttccgcgtctgtggagcgcatcgccggcatgggccttaagctccgggtcagcgaattggacgtgggcaccgacggaaacaccgaaagcagcttcaccaagcaggcggaaaaatacgccgccatcatgcggctgctgctggattataaggatcaaatggaagccgtgcaggtatggggcctcaccgacgatatgagctggcgccgggccaactatcccctgctcttcgacggcaaattcaaccccaagcccgccttctacgccgtggctgacccatacgcaaaataa

SEQ ID NO: 338 - protein, 289 aa, Unknown
  Obtained from an environmental sample.
MKPDSVLDVNASKKLSAQDETAVAVKFDAARALLDFVKENGLKVHGHVLVWHSQTPEAFFHEGYDAARPYVGRDVMLGRMKNYIKAVFEYTETNYPGVIVSWDVVNEAIDDGTNKLRQSNWFKTVGEDFVLRAFEYARKYAPEGTLLYYNDYNTAMPGKLNGIANLLKALIAEGNIDGYGFQMHHSVGFPSMEMISASVERIAGMGLKLRVSELDVGTDGNTESSFTKQAEKYAAIMRLLLDYKDQMEAVQVWGLTDDMSWRRANYPLLFDGKFNPKPAFYAVADPYAK

SEQ ID NO: 339 - DNA, 1125 bp, Unknown
  Obtained from an environmental sample.
atgcctatggagcgacccactttcttgcggtttcttgccttttttcttctttttaccatgattttcgccgccggagggtgccgaccccttgccccttcacggatggagatcgagacggatatcccctccctcaaggaagtcgccgcttcttatttcgagatcggcgcggccgtcgagccgtatcagttatcctctccaccccacgatgcccttctgcggaaacattttaactgcctcgtggcggagaacgtcatgaagcccgcctccatccagccatcggaggggtatttcaactggaccgaagcggacaagatcgtgaactacgccaaagcccacgggatgaagctccgcttccataccctcgtctggcataatcaggtcccggattggttcttcgcgggtaacgacaaaacccgccttttgcagcgcttggagaatcatatccggactatcattaaaagatatggcgataaggtcgactattgggacgtggtgaacgaagtaatagacgacaacggcggtatgcgaaacagcaagtggtaccagatcaccgggaaggactacatcaagaccgccttccgggtggcagacgacgagctcaggaagaatgggtggaggaaagaaggtcgtcagctctatatcaacgactacaacacccataacccaacgaagagagaggggatctggcgcttgatccaagagctccgggcggaagggattcccgtcgacggagtaggccaccagacgcatatcaatatcgaatggccgcccgtaagccagatcgtggaatcgatccgcttcttcggcgaaaaaggcctcgataaccaggtgaccgagctggatgtgagcatctatacgaatgacaaggattcacatggtagttatcaggccatcccgcaggaagtcttcatcaagcagggtaatcgctacaaggaactctttgaagggctaaaaagtgtaaaaaactacctcagcaacgtcaccttctggggcatggcggacgatcatacctggctgaaccgttggcccatcgaacggcccgatgctcctcttcctttcgatatctatctcaaggccaagccggcgtattgggggatcgtggatgctttgaagctttcgcggtga

SEQ ID NO: 340 - protein, 374 aa, Unknown
  Obtained from an environmental sample.
  SIGNAL (1)...(23)
MPMERPTFLRFLAFFLLFTMIFAAGGCRPLAPSRMEIETDIPSLKEVAASYFEIGAAVEPYQLSSPPHDALLRKHFNCLVAENVMKPASIQPSEGYFNWTEADKIVNYAKAHGMKLRFHTLVWHNQVPDWFFAGNDKTRLLQRLENHIRTIIKRYGDKVDYWDVVNEVIDDNGGMRNSKWYQITGKDYIKTAFRVADDELRKNGWRKEGRQLYINDYNTHNPTKREGIWRLIQELRAEGIPVDGVGHQTHINIEWPPVSQIVESIRFFGEKGLDNQVTELDVSIYTNDKDSHGSYQAIPQEVFIKQGNRYKELFEGLKSVKNYLSNVTFWGMADDHTWLNRWPIERPDAPLPFDIYLKAKPAYWGIVDALKLSR

SEQ ID NO: 341 - DNA, 1347 bp, Unknown
  Obtained from an environmental sample.
atgacaattaacaacaaaactacagcgagtcctagtattcccagcacccacaattccctcccgtcgcttcgcacactgtttaccaccagcctgctcacgctggccctgaccgcctgcggtggttcttccagcagcgacaaggacccttcaagctccagctccagtgaatcatcaagttccagcgaatcctcgagctcagcttccagcgaatcctcgagcagtgagtccagcagtagctcttccgcgggccatttctccatcgagccggacttccagctctacagcctggccaacttcccggtgggcgtggcggtctccgccgccaacgagaacgacagcatcttcaacagtccggatgccgccgaacgtcaggccgttattattgagcacttctctcagctcaccgccggcaacatcatgaaaatgagctacctgcagccgagtcaaggcaacttcaccttcgatgacgccgacgagttggttaacttcgcccaagccaatggcatgaccgtacacggccactccaccatctggcacgcggactaccaagtaccgaacttcatgagaaactttgaaggtgaccaggaggaatgggcagaaattctgaccgatcacgtcactaccatcatcgagcacttccccgacgatgtggtcatcagctgggacgtggtgaacgaggctgtcgatcaaggcacggcgaacggctggcgccattcggtgttctacaatgcattcgacgccccggaagaaggcgacattcccgaatacatcaaagtcgctttccgcgccgcgcgcgaggctgacgccaacgtagacctctactacaacgactacgacaataccgccaatgcccagcgcctggccaaaacactgcaaattgccgaggtactggacgccgaaggcaccattgacggcgtcggtttccagatgcacgcctacatggattacccgagcctgacccattttgaaaacgccttccggcaagtcgtcgacctggggctcaaagtgaaagttaccgagctggacgtatccgtagtcaacccctacggcggcgaagcacctccacaaccggaatacgacaaagaactggccggcgcgcaaaaactgcgcttctgccaaatcgccgaagtttacatgaacactgtacccgaggagttacgcggtggcttcaccgtctggggcctgaccgatgatgaaagttggctgatgcaacagttcagaaacgccaccggcgccgactacgacgacgtctggccgttactgttcaatgccgacaaatccgccaaaccggcactgcaaggcgtggccgacgcctttaccggacaaacctgcacctccgagttctaa

SEQ ID NO: 342 - protein, 448 aa, Unknown
  Obtained from an environmental sample.
  SIGNAL (1)...(45)
MTINNKTTASPSIPSTHNSLPSLRTLFTTSLLTLALTACGGSSSSDKDPSSSSSSESSSSSESSSSASSESSSSESSSSSSAGHFSIEPDFQLYSLANFPVGVAVSAANENDSIFNSPDAAERQAVIIEHFSQLTAGNIMKMSYLQPSQGNFTFDDADELVNFAQANGMTVHGHSTIWHADYQVPNFMRNFEGDQEEWAEILTDHVTTIIEHFPDDVVISWDVVNEAVDQGTANGWRHSVFYNAFDAPEEGDIPEYIKVAFRAAREADANVDLYYNDYDNTANAQRLAKTLQIAEVLDAEGTIDGVGFQMHAYMDYPSLTHFENAFRQVVDLGLKVKVTELDVSVVNPYGGEAPPQPEYDKELAGAQKLRFCQIAEVYMNTVPEELRGGFTVWGLTDDESWLMQQFRNATGADYDDVWPLLFNADKSAKPALQGVADAFTGQTCTSEF

SEQ ID NO: 343 - DNA, 2217 bp, Unknown
  Obtained from an environmental sample.
atggtggagcacgaagctgagcttcatgattaccgcgaacgaatatgcgaagttgcttggcaattcgctgggcctggagggcgagaaggcaaagcggattttgcgggaaatcaacaactggctgttttgaagatgaaattatcgagagggagggggcatggcgttttgaaacgagcaggtctgattgggcttattgcagcgatattgggctgcgcggcgctgcttatgcacaatgagatctcatccctgggaattcagctgagatcatggctcagagggagcgacaatgtgaacgctagctgggaaaaggattggaagacggctgctaacgagcaaatcgagcagctccgcaagcgcaatgtggagatcgaggtcgtcgatctgaacggaaacccgctgcctggggctaccgttcgcgcggttcagcgcacgcatcagtttggcttcggcaccgccatcaaccgaacggcgttgagcaatccggtgtacgccgattttgtcaaaaaccgtttcgaatgggtgaccttcgagaacgaggccaagtggctctggaatgaggccgtacaagggcgggtctattatcgggaggccgatcagctgctcgaatttgccaggcaaaacgggctgaaggtgcgcggacataatctgttctgggaggcggagaaatatcagccgcagtgggtgaagagtctgacgggcgctgcgctgaaggaagcgatcgataaccggctgaacagcgccgtcctgcattttaagggcaattttctgcactgggacgtcaacaacgaaatgtttcacggcagcttcttcaaggatcgcctgggggaagaaatctggacctatatgtataagcgaacccgggaactcgatcccggcgtcaagctgttcgtcaacgattacaattttatcgagtacccgccggagcgggattataaccaggtcattcaagcgctcatcgatcgggggatgccgattgacggcatcggcgcgcaagggcattttaacggagtcatcgatcccttgttcgttaagggaagactggataagctggctgagctgaatctgccgatctggattaccgaattcgattccacgcataaggacgagagagtccgtgccgataatctggagaagatgtatcggctggcgttcgcccatccggcggtcgaagggattgtcatgtggggcttctgggcgggctcccattggaagggcactgacggcgcgatcgtgaatcaagactggacgctcaatgccgccggacagcgataccagcagcttatggatgaatggacgacggtcgtcgaaggcacgaccgatcagcgcggcatgttttcgttccgggggttccacggaacctacgatatgctggtcgattaccctggagcggcggctgtgaagcagtcctttaccttggagcccggctctggcaatgcgaagctgcacattccgttcgacgttcaggacaagtccatcccggaggctcctgccaagctcagcgccgctgccgcggattcccaggttatgctgagctggagcaaggtcaacggggcaaccggctatacggttaaaagcgcggtcagcgccgacggtccctatacgccgattgcccatcagctgctcaccgagaccttcacgcacatcggtctagtgaaccggaaagattattattacgtggtgagcgccagcaaccatctaggtgagagcccggattccgccccgatccgggccactccgcgtgccgcgggcgagttacaaacgaatctcgtgcttcagtaccgctccgctgatggagataacaactatcaaatgaagcctcagttcacgatcaagaacgcaggcaaagtgcccatcccgttaagcgagctgacgatccgctactatttcacgccggagagcacgcagccggtggataccaggatcgactgggcccaattcggagcagagcatgtccagacgacggtcgttccgccatccgatgccgcggcgcacgcctatgtcgagctcagcttcctggagtcggcaggggccatcccttccgatacgacattaggcaatattcagctgcgcatctttaacagcgatggctcttcgttcgataaaacgaacgattattccttcgacccgacgaaaaaggcttatacggcgtgggagaaggtcacgctttatcggaacggggaactggtttgggggatagagccttggggcgcgaagtaa

SEQ ID NO: 344 - protein, 738 aa, Unknown
  Obtained from an environmental sample.
MVEHEAELHDYRERICEVAWQFAGPGGREGKADFAGNQQLAVLKMKLSRGRGHGVLKRAGLIGLIAAILGCAALLMHNEISSLGIQLRSWLRGSDNVNASWEKDWKTAANEQIEQLRKRNVEIEVVDLNGNPLPGATVRAVQRTHQFGFGTAINRTALSNPVYADFVKNRFEWVTFENEAKWLWNEAVQGRVYYREADQLLEFARQNGLKVRGHNLFWEAEKYQPQWVKSLTGAALKEAIDNRLNSAVLHFKGNFLHWDVNNEMFHGSFFKDRLGEEIWTYMYKRTRELDPGVKLFVNDYNFIEYPPERDYNQVIQALIDRGMPIDGIGAQGHFNGVIDPLFVKGRLDKLAELNLPIWITEFDSTHKDERVRADNLEKMYRLAFAHPAVEGIVMWGFWAGSHWKGTDGAIVNQDWTLNAAGQRYQQLMDEWTTVVEGTTDQRGMFSFRGFHGTYDMLVDYPGAAAVKQSFTLEPGSGNAKLHIPFDVQDKSIPEAPAKLSAAAADSQVMLSWSKVNGATGYTVKSAVSADGPYTPIAHQLLTETFTHIGLVNRKDYYYVVSASNHLGESPDSAPIRATPRAAGELQTNLVLQYRSADGDNNYQMKPQFTIKNAGKVPIPLSELTIRYYFTPESTQPVDTRIDWAQFGAEHVQTTVVPPSDAAAHAYVELSFLESAGAIPSDTTLGNIQLRIFNSDGSSFDKTNDYSFDPTKKAYTAWEKVTLYRNGELVWGIEPWGAK

SEQ ID NO: 345 - DNA, 849 bp, Unknown
  Obtained from an environmental sample.
atgaagatgacctacatgcatccggctgaagatacttactcgtttggtcaagcggatcagttggtcaactgggcgaaagcgaatggtattggcgtgcacggccacactctggtttggcactccgaataccaggtacccaattggatgaaaaattactctggtgatgcaactgcattccaaaccatgctcaacacccatgtgaaaactgtggctgagcattttgctggcgaactggacagctgggacgttgtgaatgaagtgctggagccgggctccaatggttgctggcgtgaaaactctctgttctaccagaagcttggcaaagactttgtcgcgaacgcattccgtgcagctcgcgagggcgatcccaatgcagacttgtattacaacgattactcgactgaaaatggtgtaacttccgatgagaagttcagttgtttgttggaactagtcgatgagcttctggaagcggacgtgccgattacaggtgttggtttccaaatgcacgtgcaggcgacgtggcctagcaatgccaacatcggcaaggcattcaaagccatcgcggatcgcggtctgaaagttaaaatttctgagctcgatgttcctgttaacaacccttacggaaccactaatttcccgcaatacagcagttttaccgcggaagccgccgagctgcagaagcagcgctacaagggcattatgcaagcgtaccttgataacgtaccggccaacctgcgtggtggtttcaccgtgtggggcgtttgggatggcgatagctggatcatgacgttcagccagtacaccaacgctaacgccaacgactggccactgttgttcaccgggccgtag

SEQ ID NO: 346 - protein, 282 aa, Unknown
  Obtained from an environmental sample.
MKMTYMHPAEDTYSFGQADQLVNWAKANGIGVHGHTLVWHSEYQVPNWMKNYSGDATAFQTMLNTHVKTVAEHFAGELDSWDVVNEVLEPGSNGCWRENSLFYQKLGKDFVANAFRAAREGDPNADLYYNDYSTENGVTSDEKFSCLLELVDELLEADVPITGVGFQMHVQATWPSNANIGKAFKAIADRGLKVKISELDVPVNNPYGTTNFPQYSSFTAEAAELQKQRYKGIMQAYLDNVPANLRGGFTVWGVWDGDSWIMTFSQYTNANANDWPLLFTGP

SEQ ID NO: 347 - DNA, 1794 bp, Unknown
  Obtained from an environmental sample.
atgcccgttttgttcgccctgtttcttgttgcctcgtcctgcgcggcgcagtcgctggccgggccggtttccctgcttggcggagatgcgggcgcggcgttccgctataccgggccatcggcgggcgcggcgagcggctcggccgaatgggtggcggtggagaacatgccgttcacgcacgcctggcggctgcgcacgaatccgctgccggagagcggcggcaacgaatgggacctgcgcatccgcgcccgcggagcggcggctgtttcggcaggggacaagatcctggccgagttctggatgcgctgcgtggagcccgaaaacggcgactgcattctgcgcctgaacgtggagcgcgacgggtcgccgtggaccaaatccatcagcaacccctacccggtgggccgggagtggcggcggttccgcgtgctgttcgagatgcgggagagctacgccgccggcggctacatgatcgatttctggatgggccagcaggtgcagacggcggaagtgggcgggatttccctgctgaattacggtccgcaggccacggccgagcagcttggcctggaccggttttatgagggcgcggcggcggacgccgcgtggcggcaggcggccgagcagcggatcgaggagatccggaaagcgggcatgatcatcgtggcggtgacgccggacggcgagccgatcgagggcgctgaaatccgggcgaagctgaagcggcacgcgttcgggtggggcacggctgtggcggcatcacggcttctggggacgggaacggacagcgagcgctaccgcaacttcatccgcgagaacttcaacatggcggtgctcgagaacgacctgaaatggggcccgttcgaagagaaccgcaaccgcgcgatgaacgcgctgcgctggctgcatgagaacgggatcacgtggatccgcgggcacaatctcgtctggccgggctggcggtggatgccgaacgacgtgcgcaacctggcgaacaatcccgaggcgctgcggcagcggattctggaccgcatccgggacacggccacggccacgcgcgggctggtggtgcactgggacgtcgtcaacgagccggtggccgagcgcgacgtgctgaacattctgggcgacgaggtgatggcggactggttccgcgccgcgaaggagtgcgatcccgaggcgaggatgttcatcaatgagtacgacattctggcggcgaacggggccaatctgcggaagcagaacgcgtattaccgcatgatcgagatgctgttgaagctcgaggcgccggtggagggcatcggcttccagggccacttcgacacggccacgccgccggagcggatgctggagatcatgaaccggtacgcccggctcgggctgccgatcgccatcaccgagtacgatttcgccacggcggacgaggagctgcaggcgcagttcacgcgcgacctgatgattctcgccttcagccatccggcggtttcggacttcctgatgtggggcttctgggaagggagccactggaagccgctgggcgccatgatccggcgcgactggagcgagaagccgatgtaccgcgtctggcgcgagctgatcttcgagcgctggcagacggatgaaacaggcgtgacgccggagcacggtgccatctacgtgcggggcttcaagggcgactacgagatcacggtgaaggcgggcgggcaggaagtccgggtgccgtacacgctgaaagaagacggccaggtgctgtgggtgacggtgggcggggcttctgaagagcgcgtgcagtaa

SEQ ID NO: 348 - protein, 597 aa, Unknown
  Obtained from an environmental sample.
  SIGNAL (1)...(20)
MPVLFALFLVASSCAAQSLAGPVSLLGGDAGAAFRYTGPSAGAASGSAEWVAVENMPFTHAWRLRTNPLPESGGNEWDLRIRARGAAAVSAGDKILAEFWMRCVEPENGDCILRLNVERDGSPWTKSISNPYPVGREWRRFRVLFEMRESYAAGGYMIDFWMGQQVQTAEVGGISLLNYGPQATAEQLGLDRFYEGAAADAAWRQAAEQRIEEIRKAGMIIVAVTPDGEPIEGAEIRAKLKRHAFGWGTAVAASRLLGTGTDSERYRNFIRENFNMAVLENDLKWGPFEENRNRAMNALRWLHENGITWIRGHNLVWPGWRWMPNDVRNLANNPEALRQRILDRIRDTATATRGLVVHWDVVNEPVAERDVLNILGDEVMADWFRAAKECDPEARMFINEYDILAANGANLRKQNAYYRMIEMLLKLEAPVEGIGFQGHFDTATPPERMLEIMNRYARLGLPIAITEYDFATADEELQAQFTRDLMILAFSHPAVSDFLMWGFWEGSHWKPLGAMIRRDWSEKPMYRVWRELIFERWQTDETGVTPEHGAIYVRGFKGDYEITVKAGGQEVRVPYTLKEDGQVLWVTVGGASEERVQ

SEQ ID NO: 349 - DNA, 1794 bp, Unknown
  Obtained from an environmental sample.
atgcccgttttgttcgccctgtttcttgttgcctcgtcctgcgcggcgcagtcgctggccgggccggtttccctgcttggcggagatgcgggcgcggcgttccgctataccgggccatcggcgggcgcggcgagcggctcggccgaatgggtggcggtggagaacatgccgttcacgcacgcctggcggctgcgcacgaatccgctgccggagagcggcggcaacgaatgggacctgcgcatccgcgcccgcggagcggcggctgtttcggcaggggacaagatcctggccgagttctggatgcgctgcgtggagcccgaaaacggcgactgcattctgcgcctgaacgtggagcgcgacgggtcgccgtggaccaaatccatcagcaacccctacccggtgggccgggagtggcggcggttccgcgtgctgttcgagatgcgggagagctacgccgccggcggctacatgatcgatttctggatgggccagcaggtgcagacggcggaagtgggcgggatttccctgctgaattacggtccgcaggccacggccgagcagcttggcctggaccggttctatgaaggcgcggcggcggacgccgcgtggcggcaggcggccgagcagcggatcgaggagatccggaaagcgggcatgatcatcgtggcggtgacgccggacggcgagccgatcgaaggcgccgagatccgggcgaagctgaagcggcacgcgttcgggtggggcacggcggtggcggcatcacggcttctggggacgggaacggacagcgagcgctaccgcaacttcatccgcgagaacttcaacatggcggtgctcgagaacgacctgaaatggggcccgttcgaggagaaccgcgcccgcgcaatgaacgcgctgcgctggctgcatgagaacgggatcacgtggatccgcgggcacaatctcgtctggccaggctggcggtggatgccgagcgacgtgcgcaacctggcgaacaatcccgaagccctgcggcagcggattctggaccgcatccgggacacggccaccgccacgcgcgggctggtcgtgcactgggacgtcgtcaacgagccggtggccgagcgcgacgtgctgaacattctgggcgacgaggtgatggcggactggttccgcgccgcgaaggagtgcgatcccgaggcgaggatgttcatcaacgaatacgacattctggcggcgaacggggccaacctgcggaagcagaacgcgtactaccgcatgatcgagatgctgttgaagctcgaggcgccggtagagggcatcggcttccagggccatttcgacacggctacgccgccggagcggatgctggagatcatgaaccggtacgcccggctcgggctgccgatcgccatcaccgagtacgatttcgccacggtagacgaagagctgcaggcgcagttcacgcgcgacctgatgattctcgctttcagccatccggcggtttcggacttcttgatgtggggcttctgggaagggagccactggaagccgctgggcgccatgatccggcgcgactggagcgagaagccgatgtaccgcgtctggcgcgagctgatcttcgagcgctggcagacggatgaaacgggagtgacgccggagcacggggccatctacgtgcggggcttcaagggcgactacgaaatcacggtgaaggctggcgggcaggaagtccgggtgccgtacacgctgaaagaagacggccaggtgctgtgggtgacggtgggcggtacttctgaagagcaggcgccgtaa

SEQ ID NO: 350 - protein, 597 aa, Unknown
  Obtained from an environmental sample.
  SIGNAL (1)...(20)
MPVLFALFLVASSCAAQSLAGPVSLLGGDAGAAFRYTGPSAGAASGSAEWVAVENMPFTHAWRLRTNPLPESGGNEWDLRIRARGAAAVSAGDKILAEFWMRCVEPENGDCILRLNVERDGSPWTKSISNPYPVGREWRRFRVLFEMRESYAAGGYMIDFWMGQQVQTAEVGGISLLNYGPQATAEQLGLDRFYEGAAADAAWRQAAEQRIEEIRKAGMIIVAVTPDGEPIEGAEIRAKLKRHAFGWGTAVAASRLLGTGTDSERYRNFIRENFNMAVLENDLKWGPFEENRARAMNALRWLHENGITWIRGHNLVWPGWRWMPSDVRNLANNPEALRQRILDRIRDTATATRGLVVHWDVVNEPVAERDVLNILGDEVMADWFRAAKECDPEARMFINEYDILAANGANLRKQNAYYRMIEMLLKLEAPVEGIGFQGHFDTATPPERMLEIMNRYARLGLPIAITEYDFATVDEELQAQFTRDLMILAFSHPAVSDFLMWGFWEGSHWKPLGAMIRRDWSEKPMYRVWRELIFERWQTDETGVTPEHGAIYVRGFKGDYEITVKAGGQEVRVPYTLKEDGQVLWVTVGGTSEEQAP

SEQ ID NO: 351 - DNA, 1860 bp, Unknown
  Obtained from an environmental sample.
atgcaccttccaaattaccgctcgctcgcaacggcgctcagtcgctacagttgctcggcgctgctggccgtcagtcttgtggcctgcgggggcaataatgaccaagatccgccgaccccggagccaactccggtcccaacgccgactccaactccaaccccgaccccgactccggagccaaccccgactccgactccggagcccactccgactccagagccaactccgacgccgaccccggaaccaacaccgacgccggagccgacgccaacaccggatcccggggccgactaccagccgcccagcaatgacattgccgtcaatggcgacgtggaaagcggtactaccaactggggtgcacgcggttcggcatccattagccgagtcactttagagagctttgaaggtgatgccagcttgagtgttaccggccgagaagacgactggcatggcgccaccttctctgtaggccatctgaccccgggtaatagctatgaagtggctgcgtgggtcaagttagcctcaggcgagcccaacacagtggtcaaaatcacgggtaagcgcgagggcgagagcgcgacttacgaagagtacacggatgtcggtacggcattggctaccgacggtagctggaccgaaattaccggcacttatattcctgatagcgccagcccatttgaatattttattgtggagacccaagagggtggaccgaccgttagcttctacgtggacgcgttttcagtggccggtgaggtggaagatacgccagcgccaacgccgcccccaaccgctccgccaccgagtggctcaggcctagcggaactagtggatttcccggtgggcgttgccgttgcggtagctagttttgccaataacgatttcctgagtaacacgcaacaacaagatatcgtgcttaacaattttagtgaaattgttgcggagaatcagatgaagatggaatatttcaacgatgactactccaaccccagggcagatcaactggtcagctgggccaatgagcgaggtattcgggttcacggccacgctttggtctggcacgcgcaagcagcgtcatgggtcagtcctccggtaagcaactttcgcgagcgttatgtcaaccatgttcgtggtgtggcatcccggtatgcggacacggtagtaagctgggatgtcgtcaatgaagctttgaccgatgatgatgtctccccgggtggaagctactaccggcaatctgagttctaccgacagttcaatggcccagagttcattgatatcgctttccgtgaagctcgagaggcagcccccaatgcgctgctttactacaacgactacaatattgagaacggactggacaaaaccgatggtttgattcagctacttgagaggttgagggataatgacgtgcccattgatggcgtgggcttccaaatgcatgttttgttggattggcccgatatcagcactattcgacgttcctgggagcgcgcattagcggttgaccccgatgaccgtatgcttttaaaaataacggaactcgatgtgcgtatcaacaatccctacgacgataatctcgaaagaggcatcgttcactccagccggggtgactgcgatgacatttccggggtctgcgaaggctttgagcggcaagccgctcgttaccgggagattattgaggcctactttgacgtcgtgccaccgcaccgccgaggtggcatcagtgtttggggtattgccgaccattatagttggtattatacccatgaaggctatgtcgattggccccttttgtgggacaggaacctacagccaaagcctgcttacaacgctgtttatgaagctctgcagcagggccaataa

SEQ ID NO: 352 - protein, 619 aa, Unknown
  Obtained from an environmental sample.
  SIGNAL (1)...(73)
MHLPNYRSLATALSRYSCSALLAVSLVACGGNNDQDPPTPEPTPVPTPTPTPTPTPTPEPTPTPTPEPTPTPEPTPTPTPEPTPTPEPTPTPDPGADYQPPSNDIAVNGDVESGTTNWGARGSASISRVTLESFEGDASLSVTGREDDWHGATFSVGHLTPGNSYEVAAWVKLASGEPNTVVKITGKREGESATYEEYTDVGTALATDGSWTEITGTYIPDSASPFEYFIVETQEGGPTVSFYVDAFSVAGEVEDTPAPTPPPTAPPPSGSGLAELVDFPVGVAVAVASFANNDFLSNTQQQDIVLNNFSEIVAENQMKMEYFNDDYSNPRADQLVSWANERGIRVHGHALVWHAQAASWVSPPVSNFRERYVNHVRGVASRYADTVVSWDVVNEALTDDDVSPGGSYYRQSEFYRQFNGPEFIDIAFREAREAAPNALLYYNDYNIENGLDKTDGLIQLLERLRDNDVPIDGVGFQMHVLLDWPDISTIRRSWERALAVDPDDRMLLKITELDVRINNPYDDNLERGIVHSSRGDCDDISGVCEGFERQAARYREIIEAYFDVVPPHRRGGISVWGIADHYSWYYTHEGYVDWPLLWDRNLQPKPAYNAVYEALQQGQ

SEQ ID NO: 353 - DNA, 1983 bp, Unknown
  Obtained from an environmental sample.
atggtttgctcggccgccctcggggcgaccgccgtcagtgcccaaaccttgagcaacaactcaaccggtaccaacaacggtttctactacaccttttggaaggactcgggcagcgcgaccatgaccctcgcagcgggtggtcgttacacctcccaatggaccaacaacaccaataactgggtgggtggtaaaggctggaacccgggcaatagcacccgcgtgatcagctattccggtaactatggcgtcagcaatagccaaaattcctacctggccttgtacggctggacccgcagcccgctgattgaatactacgtgatcgaaagctacggctcctacaacccggcatcctgctctggcggtaccaatatgggtagcttccagagtgatggcgcgacctacgatgtgcgccgttgccagcgcgtgcaacagccatccatcgatggcacccaaaccttctaccaatatttcagcgtgcgcaatccgaaaaaaggcttcggccaaatttccggcaccatcacctttgctaaccacgcagccttttgggcgagcaagggcatgaacctgggtgcccataactatcaagtaatggcgaccgagggttatcaaagtaccggcagttccgatatcacagtgagtgaaggccccatcaacggcggcaccagcagcacgcccccggtaacaaccagcagcagtgccagctcagtggcaacgggcggtggtaacaccggtagtggcgtagtggtgcgcgcgcgcggcgtcgcgggcggcgagcatattaacctgcgtatcggtggcaataccgtcgccagctggaacctcaccaccagcttccaggatctcagctacagcggcaccgcgtcgggcgatatccaggtgcaatatgacaacgacggcggcagccgcgatgtcgtagtggattacatccgcgttaacggcgaaacccgccaggcggaggatatgagctacaacaccgccttgtacgcgaatggttcctgcggtggcggcggcaattccgaactgatgcactgcaatggcgtgatcggttttggctacacctatgattgcttcagcggcaactgctccggcggcagcacggggggtggcaacactggcaccagcagcagcgcggcgagcgccggtggtggcaacagcaactgctccggctatgttggtattactttcgacgatggcccaaccgctaacactcccaccctggttaacctgttgaagcaaaacaacctgacgccggtaacctggttcaaccagggcaacaacgtggttgccaatgccaattacatggcccagcaattgagcgttggtgaagtacataaccacagctacagccatccgcaaatgggcagcatgacctaccaacaggtttatgacgagttgaaccgtgccaaccaggctatccaaaccgcgggtgcacccaagccaaccctgttccgcccaccttatggcaccgttaactccaccatccaacaagcggcccaggccttgggtttgcgggtgatcacctgggatgtggattcgcaagactggaatggcgccactgcctcggccatcgccagcgcagctaaccgcctgacaaacggccaggtaatcctgatgcacgacggcagctacaccaacaccaatgccgctattgcccagatcgcctccagcctgcgcgccaagggcttgtgcccgggtcgtatcgatccggcaaccggccgagccgttgctcctgcgggtggcaatactggcggcggtactgtgtcaagcagcactcgcagcagcactccggtagtggtaagcagcagccgtagcagcagtagtgttgccgctggcggcgcctgccaatgcaattggtggggcacccgttacccgatctgtacgtccactgccagtggttggggttgggagaacaaccgcagctgtatcaccaccagcacctgtaacagtcagggccctggcggtggtggggtagtgtgtaactaa

SEQ ID NO: 354 - protein, 660 aa, Unknown
  Obtained from an environmental sample.
  SIGNAL (1)...(18)
MVCSAALGATAVSAQTLSNNSTGTNNGFYYTFWKDSGSATMTLAAGGRYTSQWTNNTNNWVGGKGWNPGNSTRVISYSGNYGVSNSQNSYLALYGWTRSPLIEYYVIESYGSYNPASCSGGTNMGSFQSDGATYDVRRCQRVQQPSIDGTQTFYQYFSVRNPKKGFGQISGTITFANHAAFWASKGMNLGAHNYQVMATEGYQSTGSSDITVSEGPINGGTSSTPPVTTSSSASSVATGGGNTGSGVVVRARGVAGGEHINLRIGGNTVASWNLTTSFQDLSYSGTASGDIQVQYDNDGGSRDVVVDYIRVNGETRQAEDMSYNTALYANGSCGGGGNSELMHCNGVIGFGYTYDCFSGNCSGGSTGGGNTGTSSSAASAGGGNSNCSGYVGITFDDGPTANTPTLVNLLKQNNLTPVTWFNQGNNVVANANYMAQQLSVGEVHNHSYSHPQMGSMTYQQVYDELNRANQAIQTAGAPKPTLFRPPYGTVNSTIQQAAQALGLRVITWDVDSQDWNGATASAIASAANRLTNGQVILMHDGSYTNTNAAIAQIASSLRAKGLCPGRIDPATGRAVAPAGGNTGGGTVSSSTRSSTPVVVSSSRSSSSVAAGGACQCNWWGTRYPICTSTASGWGWENNRSCITTSTCNSQGPGGGGVVCN

SEQ ID NO: 355 - DNA, 1125 bp, Unknown
  Obtained from an environmental sample.
atgaaacgaaccatcttcttaagactcttagccggcgccctcctctccgccgcggccctcgcggccggggggtgccggccctctagtcccccgaaggtcgagatcgaggccaatatcccctccctcaaagaggtctgcgcttcttatttcgagatcggcgcggccgtcgagccgtatcagttatcctctccaccccacgatgcccttctgcggaaacattttaactgcctcgtggcggagaacgtcatgaagcccgcctccatccagccttcggaggggtatttcaactggaccgaagcagacaagatcgtgaactacgccaaagcccacgggatgaagctccgcttccataccctcgtctggcataatcaggtcccggattggttcttcgcgggtaacgacaaaaccctccttttgcagcgcttggagaatcatatccggactatcattaaaagatatggcgataaggtcgactattgggacgtggtaaatgaggctatagacccgagccaaccggatggcatgaggaggagcaaatggtaccagatcaccgggaaggactacatcaagaccgccttccgggtggcagacgacgagctcaggaagaatgggtggaggaaagaaggtcgtcagctctatatcaacgactacaacacccatgatccgacgaagagagagtacatctggcgcttgatcgatgagcttcaaacggaagggattcccgtcgacggagtaggccaccagacgcatatcaatatcgaatggccgcccgtaaaccagatcgtggactcgatccgcttcttcggggaaaaaggcctcgataaccaggtgaccgagctggatgtgagcatatatacggatagatccagttcctacgggagttaccaagcgatcccgcaggaagtcttcatcaagcagggtaatcgctacaaggaactctttgaagggctaaaaagtgtaaaaaactacctcagcaacgtcaccttctggggcatggcggacgatcatacctggctgaaccattggcccatcgaacggcccgatgctcctcttcctttcgatatctatctcaaggccaagccggcgtattgggggatcgtggatgctttgaagctttcgcggtga

SEQ ID NO: 356 - protein, 374 aa, Unknown
  Obtained from an environmental sample.
  SIGNAL (1)...(21)
MKRTIFLRLLAGALLSAAALAAGGCRPSSPPKVEIEANIPSLKEVCASYFEIGAAVEPYQLSSPPHDALLRKHFNCLVAENVMKPASIQPSEGYFNWTEADKIVNYAKAHGMKLRFHTLVWHNQVPDWFFAGNDKTLLLQRLENHIRTIIKRYGDKVDYWDVVNEAIDPSQPDGMRRSKWYQITGKDYIKTAFRVADDELRKNGWRKEGRQLYINDYNTHDPTKREYIWRLIDELQTEGIPVDGVGHQTHINIEWPPVNQIVDSIRFFGEKGLDNQVTELDVSIYTDRSSSYGSYQAIPQEVFIKQGNRYKELFEGLKSVKNYLSNVTFWGMADDHTWLNHWPIERPDAPLPFDIYLKAKPAYWGIVDALKLSR

SEQ ID NO: 357 - DNA, 1155 bp, Unknown
  Obtained from an environmental sample.
atgaataacttcagaaatacatttctaatcgtcgttgtactggcggtcgtcgtcggcgtgctgccggcctgcgaagccggtccgccggaaaatacaagttcgtccctgcaggaggcatatgcagatgtgtttctgatcggcaccgcgctcaatctggcacagatcgacggaagggatgaacaaggcgtacgtctggtggagcggcattttaatgcgattacaccagagaacattacaaaatggggaccgatacatccggcgccgggcgaatataatttcggaccggccgaccggtttgttgaattcggtgaagcccacgacatgttcatgataggccatacgcttgtatggcacagccagacgcccggatgggtattcgaggatgaagccggaaatccgctcggccgcgacgagctcatcgaacgcatgcgcgatcatatccataccgtcgtcggacggtaccggggtagaatacacgcatgggacgtcgtcaacgaagcgttgaatgaagacggaaccctgcgggaatccccctggtaccgtatcatcggcgaggattacctgttgaaagcgttcgagttcgcgcatgaagcggacccggatgccgagctgtactataacgattattctctcgaaaatcccgccaagcgggcgggggcggtacgcctggtccggtacctgcaggagaacggggcgccgatacacgggatcggtacccagggacactactctcttgactggccatcgctcgacgagatcgaaagaaccatcaccgatttcgccgcgttggacgtggacgtcatggttaccgaacttgaaatcgacgtcctcccttccgcgttcgagtatcagggggccgatattgcgatgcgggcggaactcgaagagcggttgaatccgtatcccgacgaactgccggccgaggtcgatgaagcgcttacacagcggtatcgggacatcttcgaggtatttctgcggcacagcgacgttcttacgcgcgtaacgttctggggggtgaccgatggagattcgtggaagaataactggccggtaccgggaaggacgaattatccgctgctgttcgaccgcgaatggcagccaaaaccagcattttattccgtgatcgaagttgcggatgagatgctgaatgaataa

SEQ ID NO: 358 - protein, 384 aa, Unknown
  Obtained from an environmental sample.
  SIGNAL (1)...(25)
MNNFRNTFLIVVVLAVVVGVLPACEAGPPENTSSSLQEAYADVFLIGTALNLAQIDGRDEQGVRLVERHFNAITPENITKWGPIHPAPGEYNFGPADRFVEFGEAHDMFMIGHTLVWHSQTPGWVFEDEAGNPLGRDELIERMRDHIHTVVGRYRGRIHAWDVVNEALNEDGTLRESPWYRIIGEDYLLKAFEFAHEADPDAELYYNDYSLENPAKRAGAVRLVRYLQENGAPIHGIGTQGHYSLDWPSLDEIERTITDFAALDVDVMVTELEIDVLPSAFEYQGADIAMRAELEERLNPYPDELPAEVDEALTQRYRDIFEVFLRHSDVLTRVTFWGVTDGDSWKNNWPVPGRTNYPLLFDREWQPKPAFYSVIEVADEMLNE

SEQ ID NO: 359 - DNA, 2724 bp, Unknown
  Obtained from an environmental sample.
atgacccggtctgtacgaccaagagcatggggggccggcctactggccctcgcgatggtggcgacagtcgcccccacggccaccggccacagccacgacacggcagagcccgtcgtcgtggtctacaccgacttcgagaacgacagcatcgagccgtgggcgcagtccggcggcccgacgctgaacatcgtcgaggtcgacggcgggcacgcgctgcgcgtcggcaaccaccagaacacctgggacggcatccagacccagcccgccaccacgcggatcgagccgggtgtcgagcacaccctgtcgatgcgcgtccggctcgtgggcgacggcacggcgacgacgccggcccggtggatcggccgcgaccccggagccgagaacggctaccagtggatcggtaacacgacgatctcgaccgagagctggacgaccatccggggaacgtggctccctcgggcggacgcgaacgcctcggagctctatgtctaccccgaggtcacaccggtggccggcttcgactacctcctcgatgacctgctcatcgagcgtgctgcccctgtcgacggcggcgccccgggcaccgtcgtctacaccgctggattcgagacggacctggacggctgggaggcacgcgccgacggcgtcggtgtcggccagctcgaccggaccgacgcggagtcggccgagggcgactggtccgcgatcgtgaccgaccgcacctcgcacggccacggcctgcgcctggacgtcacggacatcatggacgcgggcgtcacgtacgagatcagcgcccaggtgaagttcgccgggaccggtggtccgggcaacatctggctgagccaggagctggtcgtggacgggggtagcacctacggcaccgtcctccaggtccctggcgtcacctcgacagcctggacgcagatcaccacgaactacgtcacgccgacggccgaccagctgttcctctacttcgagacgaactggccggacggcatcgaggacgacttcctcctcgacgacgtccgcatccgtgtcgcccctcgggcgatcatccaggaggacctcactccgctgatggacacgctggacgtgcccatgggtgtcgcgatcgaccagcgtgagacctccggcagcctcgcggacctcctgctgctgcacttcgaccaggtcacggccgagaaccacatgaagccggaggcgtggtacgacgcggcgggcaacttccgcatccacccgcaggcccgcgccatcatggacttcgcggcggagaacgacctgcgcgtcttcggtcacgtcctggtgtggcacggccagaccccggacttcttcttcacgcacgcggacggcaccccgctgacctcgagcgaggccgaccaggcgatcctgcgcgaccgcatgcgcacgcacatcttcaacgtcgccgaggccctctccgagtggggcgagtacggcggcgacaacccgctcgtggcctgggacgtcgtcaacgaggtcgtctccgacagcggcgagcacagcgacggcctgcgccgtagccgctggtacgacgtgctgggcgaggagttcatcgacctggcgttcatctacgcgaaccaggcgttcaacggtgagttcgccgctgacgacgccaaccacccggtcacgctcttcatcaacgactacaacaccgagcagtccggcaagcagaaccggtacgccgcgctcatcgaccgcctcatcgagcgcgaggtcccgatcgacgccgtggggcaccagttccacgtcagcctggccatgcccatcgcgaacctgcgcggcgccctcgagcgcttccaggacaccgggctgatccagggcgtcaccgagctcgacgtcaccgtcggcaacaacccgaccgaggcgctgctcgtcgagcagggctactactaccgggacgccttccggctgttccgtgagttcacggaggacctctactcggtcaccgtgtggggtctcaccgacgaccgcagctggcgcagcgctcaggcgccgctgctgttcgacgcgggcctgcaggccaagccggcctactacggcgccatcgacgccgacctggacgcacgcgtgcgtgcggcctacgtgttcgccgaggacatcgccctcgacgaggccgcgctgacgagccccacctgggaccgtctgccgctgcaccagatcgacggggccggcgagttccagctccgctgggcggccgaccacctcacggtgttcgtccacgtcaccgacggtgacgaggtcgagatcgtgctcggcgacgagacctacacggtctcgtcggacggcgagggcgacctggacgcggtcaccgcggccggggagaacggctcctggaccgctgtggtccgcgtgccgctcacggccgagcagggcgacaccgcccagttcgacctccggatcatcgacggcgccaccacctccgggtggaacgtcgaaggtgtcctgggcaccctgaccctggtcgaggagctgtccttcgtcgaggtcgtcgaggcggccgaccggccgaccatcgacggcgagatcgacgccgtgtgggaggacgccaacgtcgtcaccacggacgtccgtatcgagggcgctgctgacggcgcgaaggccgagatccggaccctgtgggacaacaacacgctgttcgtcctcgcggagatcgccgacccggtgatcgacgtgacggcctccagcccgtgggagcaggactcgctc

SEQ ID NO: 360 - protein, 908 aa, Unknown
  Obtained from an environmental sample.
  SIGNAL (1)...(31)
MTRSVRPRAWGAGLLALAMVATVAPTATGHSHDTAEPVVVVYTDFENDSIEPWAQSGGPTLNIVEVDGGHALRVGNHQNTWDGIQTQPATTRIEPGVEHTLSMRVRLVGDGTATTPARWIGRDPGAENGYQWIGNTTISTESWTTIRGTWLPRADANASELYVYPEVTPVAGFDYLLDDLLIERAAPVDGGAPGTVVYTAGFETDLDGWEARADGVGVGQLDRTDAESAEGDWSAIVTDRTSHGHGLRLDVTDIMDAGVTYEISAQVKFAGTGGPGNIWLSQELVVDGGSTYGTVLQVPGVTSTAWTQITTNYVTPTADQLFLYFETNWPDGIEDDFLLDDVRIRVAPRAIIQEDLTPLMDTLDVPMGVAIDQRETSGSLADLLLLHFDQVTAENHMKPEAWYDAAGNFRIHPQARAIMDFAAENDLRVFGHVLVWHGQTPDFFFTHADGTPLTSSEADQAILRDRMRTHIFNVAEALSEWGEYGGDNPLVAWDVVNEVVSDSGEHSDGLRRSRWYDVLGEEFIDLAFIYANQAFNGEFAADDANHPVTLFINDYNTEQSGKQNRYAALIDRLIEREVPIDAVGHQFHVSLAMPIANLRGALERFQDTGLIQGVTELDVTVGNNPTEALLVEQGYYYRDAFRLFREFTEDLYSVTVWGLTDDRSWRSAQAPLLFDAGLQAKPAYYGAIDADLDARVRAAYVFAEDIALDEAALTSPTWDRLPLHQIDGAGEFQLRWAADHLTVFVHVTDGDEVEIVLGDETYTVSSDGEGDLDAVTAAGENGSWTAVVRVPLTAEQGDTAQFDLRIIDGATTSGWNVEGVLGTLTLVEELSFVEVVEAADRPTIDGEIDAVWEDANVVTTDVRIEGAADGAKAEIRTLWDNNTLFVLAEIADPVIDVTASSPWEQDSL

SEQ ID NO: 361 - DNA, 5040 bp, Unknown
  Obtained from an environmental sample.
atggcaagaagtaagcgagtattagcatggattatgtctagtgtgcttctgatatccatggcgatgccatccttcgcatcaggtgattcaagccaagtgccaagggttatatttgaaacaggttttgaaacgggattagatggcttcaaaggacggggtagtgccaccttaactcgaacgactgatgaaacgcaagcaggcgactattcggttcttgtgagcaatcggcttgagcactggaatggggcatcattgccacttacaggcttcgttctaccaggtaatacatatgaatttgttggttacataaaagcaaaagcagatgtagcagacaattatgtcatgagtggtgagtacaatgaggggatttctggaaatcaatatccatggatatctaatcgtttgttaacggttcaagatggctttgttgagtttagaggtgaactaaccatactagaggatatgacgtcctttaatctaaactttgaacatcaaaatgctgaagtggaattttatttagattctgttcaggttattctaatcgaagaaggtcaagtcaatgacttaccaatgaatgtaagaagagcgccacttacacttgctgaaactcccttacatgagatttgggcagatcactttactattggcaatatttatacgccaggttttcgcacagatatacgtggtgaggtattagcccatcattttaatgtgatcacagctgaaaatattatgaagccagatcatttgcaaagggaacaaggtatttttacttttagtgcttccaacgatatgatggaatttgccagagcaaataatcaagaagtcattggacatactttggtgtggcattctcaatccttcccatggtttgaagctttaaatccaacacgtgatgaagctatagccattatgcatgcccatattgaaactgttatgggacattttaatgaaaactacccaggtgtcattacaggatgggatgttttgaatgaagccattcaaccaagacagggtcaagatcctgaaaattggcgcttgcatttaagggataccaaatggttacgtgccattggtgatgattatattgccatcgcttttaacaaagcccatgaaatggatccagatgctattctttattataatgattataatgataatgactattttaaagcaaccattataaaagccatggtgcaggagttgcgtaatgaaggcgtgcccattcatcgtattgggatgcaaggtcattataatttacagacaccattaaactctattagaaccagcgttgagcgttttagtgaaattactggtcatgaagatctaccacctattggcattagtttcacagaaattgatgtaacggtaccagggtttgaaagtgcagcccgtttacctgaagaggtagaaattcgccaagctcagttttatgctcaattaatgcagattttaagagacaacagcgatgtgattcatcgtgttactttctggggtatgtctgatcgtgaatcatggcgtgcagatcgtcatcctaacatgttagatcctcagtatggtccaaagcatgtctttcatgctatagccaatccagaggctttccttacggcctacccattaccagagacgccagatgctcaaacagcctatgcatctcaaggtcaaccagttgtggggcagtttaatttggatgcgtatcaaaattcagaagtaataccagtggctaatcaaatgacagcccataatggcgcaacagcggttgcaagggtggtttggcacgaagatgctatttatattttagccaatgtcagcgatgccacaccgaatgtagcagcttcggctgcccatgagcaagactcacttgaggtatttatttcaaatacggattcaagaatttctaattatatgccaggtgactatcaactgagatttaatcgtgccggcgtgcatacatatggttcgactggttcgattgaaggtatgacctttgcggtacaagatggtccaataggttatcaagttgaagtgcgtattcccttagaaaatgaagtctatgttggcagaagacttggttttgacttacaagtcaatgatgcatgggaagttggcggtacttctggccgacaagcatttgctaaatggaatgatcacactgacaatggctggcagtctacagagttttggggctggttattattacaaggcgatgcggcacctgtcttacccgttgtattagtggaagaaggctttgaaacggatttaggttcattccaaccaaggggtagtagtacactgactcgaacccaagaggttagtcatgaaggcgactattccgtattggttagcaaccgtgtcaacaactggaacggtgcgtcattaccgttaacaggcattgttcaaccaggcaacacttatgagtttgttggttacattagagcaaaagcagatgtaactggatcatatatcatgagtggtgagtttaataatggatctggtgtattagaaaacggtagtattaatcgatggccatggctatcaaaccgttcattaacgatagcagatggttttgttgagtttaagtcagaactaaccatacctagtgacatgacgacgtttaacttgaactttgaacaccaaaatgctgaagtagaattttacttagatgctgttcaagtcactttgattgcagaagctgatgtaacaccagtggacccaccagtagacccaccagtagagccagaaattacagtggtctattcaatggtagatgatgcagccattcaagggattgaagtgggaacaacaggcactgctgaagatttttcggatattagtgaagctttattagtatctggttcaccagttgttactgctgtagcacatccagaagaagcaggaaagatcggtatagagcttagtaatcgagcagagaattggcatgcgctagactttatgttcccagccataggtgtgcagcggggtgggagctatcgatttgtggccagtggccgtatggcagaaggaacaggtaattcaaatcgtagaatgcagtggaatcaaacggatgcgccatggagtgaaatatcaggttctagaaccaatgtggcacctgcagcaaccacatggaccattgacgtgactttaagtcgattacagatcaacacattattaaacgctggtcaaagaggtcttcgaattcaaacgggtaatgcaccaactgtgaccattaccattgacgatgtgtttgtttatcagattggtgacattgacacagcaggtttaccattaccaccacaatggaattttgatttgccaagattatcagaattattcgagccatattttggtcttggtaacatttattcaaccgaaacattaatgaacgctaatgaaacaaaaagagcatttttacatcactttaacgtgattacagcagaaaatggtcataaaccatccagtattgcagggccagaaaatagctttacagtaccagaacctgagcaattcaactttacggatgcagaccgaattgtaaactttgctgttgaaaatgacattgaattagtaggacatgcacttgtatggcattcacaaagtccaaactggctgtttagaagtgcggctaacacaccgctaacaagagcagaagccaaagagcgcatggcatattacatgaaaactgtttcagagcatttcgaagcacaaggtacattaggcgcattttatggttgggatgttgtgaatgaagccatcgccagtggtggtggtacattcgtagatcaaccaggtcattggcgcacgcaaatgcgaacatcatcaccatggttccaagcatttaacaatggattagatgtagaagccggtgaacatgccagtgattatattttctatgcatactattatgcaagaaagtatttcccaacatcgatcctatactacaacgattacaacgatgaaataccaaacaagcgagacaatatcgctcaaatggtagaagagataaatgcactttgggaagcacatgaagaatatgatggtcgcttactgattgaatccatcggtatgcaaagtcattatcacatggaaggttggacaaccagcgtagacaatgtaagagctgctttagatcgatacattgcaacaggtgcaagagtcagtgtgactgagttagatatcacttatggtggtcatggtagtaatgcatatgcatcacttacaccagaacaattagcggcacaagcggagcgatatgcagagatatttacattgtatttagagcgtgcagatcagttaagccgtgtatccatctggggtatgtctgatgctaacagctggagaagttctggattcccattactatttgacagttcacttaatgctaaaccagcatttaatgccattgtagaattagttaaaaactgggagacaccaacagttgtagcaccagtgattcaaacaagaacactagcaccattagaaagtggtgaaagagtctttaccatgttagatgtggtaagaggatctaatgcacctgtatggtttagcataacagacggtgcattaccagaaggtataatccttcattctagaacaggtattttagaaggaacaccagttgaagatggtcactatagctttactgtaactgctagaaattacggcggttcaacaagtcaagcgctgactttaacagtaggtcatccagtagcaccaccagtaacgccaccagtaacgccaccaaccgtaatcattgatgaatcggatataccacaggctggtccaggccttagggcaccacagattgttgtaaccgttcaagaaggcagtgaagtaacgtttgatcttgaaaaattagaagaagttatggcatcactttcaagtcaagtgccattggtgttagatgttgaattggaagattctatcatcaccttggatcaaacattacttaaacgattaacagacaaggcggctggaatcgaaatacaagcagatggatttagttatatgcttccagcagaggtattagaggcaattctttgg

SEQ ID NO: 362 - protein, 1680 aa, Unknown
  Obtained from an environmental sample.
  SIGNAL (1)...(26)
MARSKRVLAWIMSSVLLISMAMPSFASGDSSQVPRVIFETGFETGLDGFKGRGSATLTRTTDETQAGDYSVLVSNRLEHWNGASLPLTGFVLPGNTYEFVGYIKAKADVADNYVMSGEYNEGISGNQYPWISNRLLTVQDGFVEFRGELTILEDMTSFNLNFEHQNAEVEFYLDSVQVILIEEGQVNDLPMNVRRAPLTLAETPLHEIWADHFTIGNIYTPGFRTDIRGEVLAHHFNVITAENIMKPDHLQREQGIFTFSASNDMMEFARANNQEVIGHTLVWHSQSFPWFEALNPTRDEAIAIMHAHIETVMGHFNENYPGVITGWDVLNEAIQPRQGQDPENWRLHLRDTKWLRAIGDDYIAIAFNKAHEMDPDAILYYNDYNDNDYFKATIIKAMVQELRNEGVPIHRIGMQGHYNLQTPLNSIRTSVERFSEITGHEDLPPIGISFTEIDVTVPGFESAARLPEEVEIRQAQFYAQLMQILRDNSDVIHRVTFWGMSDRESWRADRHPNMLDPQYGPKHVFHAIANPEAFLTAYPLPETPDAQTAYASQGQPVVGQFNLDAYQNSEVIPVANQMTAHNGATAVARVVWHEDAIYILANVSDATPNVAASAAHEQDSLEVFISNTDSRISNYMPGDYQLRFNRAGVHTYGSTGSIEGMTFAVQDGPIGYQVEVRIPLENEVYVGRRLGFDLQVNDAWEVGGTSGRQAFAKWNDHTDNGWQSTEFWGWLLLQGDAAPVLPVVLVEEGFETDLGSFQPRGSSTLTRTQEVSHEGDYSVLVSNRVNNWNGASLPLTGIVQPGNTYEFVGYIRAKADVTGSYIMSGEFNNGSGVLENGSINRWPWLSNRSLTIADGFVEFKSELTIPSDMTTFNLNFEHQNAEVEFYLDAVQVTLIAEADVTPVDPPVDPPVEPEITVVYSMVDDAAIQGIEVGTTGTAEDFSDISEALLVSGSPVVTAVAHPEEAGKIGIELSNRAENWHALDFMFPAIGVQRGGSYRFVASGRMAEGTGNSNRRMQWNQTDAPWSEISGSRTNVAPAATTWTIDVTLSRLQINTLLNAGQRGLRIQTGNAPTVTITIDDVFVYQIGDIDTAGLPLPPQWNFDLPRLSELFEPYFGLGNIYSTETLMNANETKRAFLHHFNVITAENGHKPSSIAGPENSFTVPEPEQFNFTDADRIVNFAVENDIELVGHALVWHSQSPNWLFRSAANTPLTRAEAKERMAYYMKTVSEHFEAQGTLGAFYGWDVVNEAIASGGGTFVDQPGHWRTQMRTSSPWFQAFNNGLDVEAGEHASDYIFYAYYYARKYFPTSILYYNDYNDEIPNKRDNIAQMVEEINALWEAHEEYDGRLLIESIGMQSHYHMEGWTTSVDNVRAALDRYIATGARVSVTELDITYGGHGSNAYASLTPEQLAAQAERYAEIFTLYLERADQLSRVSIWGMSDANSWRSSGFPLLFDSSLNAKPAFNAIVELVKNWETPTVVAPVIQTRTLAPLESGERVFTMLDVVRGSNAPVWFSITDGALPEGIILHSRTGILEGTPVEDGHYSFTVTARNYGGSTSQALTLTVGHPVAPPVTPPVTPPTVIIDESDIPQAGPGLRAPQIVVTVQEGSEVTFDLEKLEEVMASLSSQVPLVLDVELEDSIITLDQTLLKRLTDKAAGIEIQADGFSYMLPAEVLEAILW

SEQ ID NO: 363 - DNA, 1317 bp, Unknown
  Obtained from an environmental sample.
gtgaccacccgcgcacaggttcttgatcaggcgctggcactgggccaccggtgtggctgggaaaaactcagcctggacgccatcgccagggcgctgggccgttttggcagcctggctctgtgtgtcgcgctgttgagcgcctgcggcagtagtagtagctccctggatgatccgggtgctggcagcagttcttccagctctgagagcagccaaagctccagcgccagttcccaggctgatggcgacggtacccaggacagcctctacgcccaggcggacttccctgtaggggttgcggtgcaggtggccaattgggagcctttcagcctgtttaccgcgcccgatgccgctgcgcgtcagaacctggttgcccgacacttctccgaagtgaccgcgaccaacgtcatgaaaatgtcctatatgcgcaccaacagtggtggttttaccgacgcgccggcgcgtccgctgattgattttgcccgcgccaatggcatcaaagtgcacggtcacgcactggtctggcatgcggattatcaggtgccaaatgtgtttcgtgactacgaaggggacaattggcaggggcttttaaccgagcatgtcgagggcgttatggggctgtttgacgacaccgtggtaagttgggatgtcgtaaacgaagcggttgataccggctcacctgacggctggcgccggtcgattttctataattttgcgccgccggaagcagggcaggtgccggaatatattgaagtggcttaccaggccgctcgagaggccaatccggaagtgaccctctactacaacgattttgacaacacggccaataccgggcgcctcaacaagaccctggaaattgccgatcgcctgaaagagctggacgcgatcgacggtatcgggttccagatgcacgcctatatgaactacccgagtattgcgcagtttcgcaatgcctttcaggaagtggtcgatcgtgacctgaaagtcaaagtcaccgagctggacattgccatcgtcaacccttacggcagctcgacgcctccgccgctgccggagtttgatcaggcgctggccgacgcccaaggtgtccgttactgccagattgccgaggcctatctggatgtcgttcctgccgagctgcggggtggtttcaccgtctggggcctgaccgatgacgacagctggctgatgggagcgttcgcgtccgcaaccggcgcccaatacgaccaggtctatccggtgttgtttgacgataatctgcaagccaagcccgcgttctttggcgtcaagcgcgccctccgcggcgaaccctgcgagtaa

SEQ ID NO: 364 - protein, 438 aa, Unknown
  Obtained from an environmental sample.
MTTRAQVLDQALALGHRCGWEKLSLDAIARALGRFGSLALCVALLSACGSSSSSLDDPGAGSSSSSSESSQSSSASSQADGDGTQDSLYAQADFPVGVAVQVANWEPFSLFTAPDAAARQNLVARHFSEVTATNVMKMSYMRTNSGGFTDAPARPLIDFARANGIKVHGHALVWHADYQVPNVFRDYEGDNWQGLLTEHVEGVMGLFDDTVVSWDVVNEAVDTGSPDGWRRSIFYNFAPPEAGQVPEYIEVAYQAAREANPEVTLYYNDFDNTANTGRLNKTLEIADRLKELDAIDGIGFQMHAYMNYPSIAQFRNAFQEVVDRDLKVKVTELDIAIVNPYGSSTPPPLPEFDQALADAQGVRYCQIAEAYLDVVPAELRGGFTVWGLTDDDSWLMGAFASATGAQYDQVYPVLFDDNLQAKPAFFGVKRALRGEPCE

SEQ ID NO: 365 - DNA, 3246 bp, Unknown
  Obtained from an environmental sample.
atgaaccacttcgcttcaaaatcgctgcgcatggcgtggcaacccggactgcttgcgacaaccgtgctgccgttggcggctgccgccccaataccagcgccgaatacggataccaaagtgagcaatacttcgtccatcaccactccggctgcggctccacagtcgcagccacaaccaacgcaagacgcaaacgctcccgcaccgcttaaagcggctttccgggataagtttctcatcggcgcggtgctgagtgacgctgcgctgcgaggcagtgcgcccgacaaggtggcgatagccaccacgcactttaacgcgctcaccgccgaaaacgccatgaagccagacgcgatgcaaccgcgcgaagggcagttcaacttcgctgcaggcgatcggctcgtcgaactcgccgaaaaaagcggcggtgtgcccatcggccacacgctggtgtggcacgcgcaaacaccgaagtggttttttgaagggccggatggacagcccgcgacgcgcgaactggctttggagcgcatgcgcaaacacatttccactgtggtggggcgctacaaagggcgcatcaaggagtgggatgtggtgaacgaagccatcaacgacggacccggtgtgctgcgtccctctccctggctcaaagccatcggcgaagattacatcgccgaagccttccgcgccgcgcacgccgccgaccccgacgcgattttgatttataacgattacaacatcgaactgggctacaaacggcccaaagcgctgcaactcctaaaatcgctcattgaccagaaagtgccgattcacgccgtgggcattcagggtcactggcgcatggacaacccgaacttcgccgaagtggaacaggccatcaaagagttttcggcgctggggttgaaagtcatgatcaccgaactcgacatcggcgtgctgccgacgcgttatcagggcgcggatatttcagcgaccgaaaccatgacgcccgaacagcgcgccgtgatgaacccctatacggacggattgccggacgatgtggcgcaaaagcacgccgagcgctatcgccaggcgtttgagatgttcctgcggcacaaagacaaaatcagtcgtgtgacattttggggtgtggacgacggcacttcgtggctgaacggtttcccggtgcgcggccgcaccgattatccgctgctatttgatcgtcagggcaagccaaaacccgcctttttcgcggtgcaaaacgcggcgatgggcgcaacagcgcaaccgagcgccagcgctcccgcaacgcatggcgccgctcctgcatccaccaacattcgcggcgccgagtttcctcgcgtggaaagcgacgggcgggtgacgtttcgcatcaaagcgcctgacgcgcaaaaagtgcaatttgatttaggtaagccttacgacgccacccgcgacgccgagggcaactggacggcgaccacagagccacaagtgcccggcttccattattattttttgattgtcgatggagtgcgcgtggccgacccggcgagcgaaaccttttacggtgcgggccgccagatgagcggcatcgaaattcccgatcccgacagcgcgttttattcgccgcaaaacgtgccgcatggcgaagtgcgcgaacgctggtatttttccaacaccacgcaggcgtggcggcgcatcttcatttatacgccgccgggttacgacaccgatcaggccatgcgttttcctgtgctgtatttgcagcacggcggtggcgaagacgaacgcggctggcccaatcaggggcgcgtgagctttatcatggacaatctcatcgcgcagggcaaagccaaaccgatgctggtggtgatggagcaaggctatgcgcgcaagcccgatgaaccgcaggtgccgctgcgcccgcccggaagcaacgccggagcgatgccgcccgactttaatcgcatgttcgccacgctgggcgaagtgttcaccaaagacctgattccgtttattgacgcaaattaccgcaccaaaaccgagcgcgaaaaccgcgcgatggccggactttcgatgggtggaatgcaaagtttcatcatcggcctggcgaacaccgatctattcgcgcacctcggcggtttcagcggcgcgggtggtggttttggcggcggcgccttcgacgccaaaaccgcgcacggcggtgtgatggccgatgccgatgccttcaacaaaaaagttcgcacgatgtttctcagcatcggcactgccgagaacgagcgttttcagagcagcgtgcgcggttaccgcgacgcgctgaccaaagcgggcatcaaaaccacgttctacgaatcgcccggcacttcgcacgagtggctgacatggcgccgcagcctgcgcgaattcgcgccgctcttgtttcaagaggccaacacgcagatcgagcgcggccccaatgcccgcccgattgcgccgcagccgattgttcttggcccgggcgacaagcccgccttccctccggcgccctccggtttcgatgcgcggcgcgatggcattccgcacggcgaaattaaacttgtggaatacccttctgccacggtcggcaccacgcgcaagatgcaggtctatacgccgccgggctacaacccgcaagaagaatatcccgtgctctatttgctgcacggcatcggcggcgacgagtgggaatggaaaaatggcggcacgcccgaagtgattctcgacaacctctacgctgagaagaaactccagccgatgatcgtggtgatgcccaatgggcgcgcgcaaaaagacgaccgtcctatcggcaacgtgttcgcttccgctccggcgtttgcgacgtttgagaaagatttgctgaacgacattatcccctttgttgagaagaattacccgaccaaaaccggcccgcaaaatcgcgctttggccggtctttcgatgggcggcgggcaatctctcaactttggcctcggcaacctcgacaccttcgcgtgggttggcggcttttcgtccgcgcccaacacgcgcagcggcgcaagtctactggccaatcccgacgacgccaaaaagaagctgaagctgctgtgggtttcgtgcggcgataaagacaatttgatgtttatcagccagcgcacgcaccgttatcttgccgagaataacgtgccgcacatctggcatgtacagcccggcggacacgacttcaaggtgtggaagcaagacctgtataacttcgcccaactgctattccgttaa

SEQ ID NO: 366 - protein, 1081 aa, Unknown
  Obtained from an environmental sample.
  SIGNAL (1)...(65)
MNHFASKSLRMAWQPGLLATTVLPLAAAAPIPAPNTDTKVSNTSSITTPAAAPQSQPQPTQDANAPAPLKAAFRDKFLIGAVLSDAALRGSAPDKVAIATTHFNALTAENAMKPDAMQPREGQFNFAAGDRLVELAEKSGGVPIGHTLVWHAQTPKWFFEGPDGQPATRELALERMRKHISTVVGRYKGRIKEWDVVNEAINDGPGVLRPSPWLKAIGEDYIAEAFRAAHAADPDAILIYNDYNIELGYKRPKALQLLKSLIDQKVPIHAVGIQGHWRMDNPNFAEVEQAIKEFSALGLKVMITELDIGVLPTRYQGADISATETMTPEQRAVMNPYTDGLPDDVAQKHAERYRQAFEMFLRHKDKISRVTFWGVDDGTSWLNGFPVRGRTDYPLLFDRQGKPKPAFFAVQNAAMGATAQPSASAPATHGAAPASTNIRGAEFPRVESDGRVTFRIKAPDAQKVQFDLGKPYDATRDAEGNWTATTEPQVPGFHYYFLIVDGVRVADPASETFYGAGRQMSGIEIPDPDSAFYSPQNVPHGEVRERWYFSNTTQAWRRIFIYTPPGYDTDQAMRFPVLYLQHGGGEDERGWPNQGRVSFIMDNLIAQGKAKPMLVVMEQGYARKPDEPQVPLRPPGSNAGAMPPDFNRMFATLGEVFTKDLIPFIDANYRTKTERENRAMAGLSMGGMQSFIIGLANTDLFAHLGGFSGAGGGFGGGAFDAKTAHGGVMADADAFNKKVRTMFLSIGTAENERFQSSVRGYRDALTKAGIKTTFYESPGTSHEWLTWRRSLREFAPLLFQEANTQIERGPNARPIAPQPIVLGPGDKPAFPPAPSGFDARRDGIPHGEIKLVEYPSATVGTTRKMQVYTPPGYNPQEEYPVLYLLHGIGGDEWEWKNGGTPEVILDNLYAEKKLQPMIVVMPNGRAQKDDRPIGNVFASAPAFATFEKDLLNDIIPFVEKNYPTKTGPQNRALAGLSMGGGQSLNFGLGNLDTFAWVGGFSSAPNTRSGASLLANPDDAKKKLKLLWVSCGDKDNLMFISQRTHRYLAENNVPHIWHVQPGGHDFKVWKQDLYNFAQLLFR

SEQ ID NO: 367 - DNA, 1338 bp, Unknown
  Obtained from an environmental sample.
atgaaaagaattggattactatttatggcgttggcgctaaccgcatttatggcgcagcattcgtccgctcaaaggatttgcaataaccaaacagggacccatggtggattctactacacatggtggagtgatgggggtggatctgcatgtataacaatgggcgatggcggtaactacagcacccaatggagcaataccggtaactttgtaggcggtaagggttggagcacaggaagatccaaccgcgtaattagttacaatgctggtaactggtcgccatcgggtaatgcttacctatgtttatatggctggactaccaacccgcttgttgagtactacgtagttgatagctggggttcttggagacctcccggagcaacatcgcagggaacagtaaatactgatggtggcacctatgagatatacagaactcagcgtgtaaaccagccatctattcaggggaatactactttctatcagtattggagcgttagaacctctaaaagggccactggaagcaatgctaccatcaccttccagaaccacgtaaatgcttgggcaagtaggggttggaacttgggagctcatagctatcaggtactggctaccgagggttatcagagcagcggaagttcaaatattactgtttgggaaggtggttcaagtggaggttcttcaggtggaagcaccggaggcagcactggaggtggatcacacgagatcattgtaagagcccgtggtgtagtaggttcagagcaaattaggcttagggttggcaatacaaccgttgcaacttggacccttactaccggttatagggactatagggctactacctcagctactggtggtattctggtagagtacttcaatgatagcggcaaccgtgatgttcagattgattacattagggtaaacggctcaactcgtcaatctgagaacatgtcgtacaatacaggggtatggcagaatggctcatgcggcggctccaatagcgagtggctacactgcaacggagctattggctacggcgatgtggttactggcagatcaaccgctgttgaggaagcatttactgctgccgaggattgtggctgtgaacctaaggcaaccctattccccaaccctgctggcagtaccctcagtattatgctagacaggcaaccctatggcgatgtaagtattagaatatataatacggtaggtgcagttgttcgcaccatcaacaatccagacctactcactgaggttgatgtcagtgcattaaattctggaatctactttgtagagcttaggtccgaaggacatgtaagcaactacaaatttattaaaaagtag

SEQ ID NO: 368 - protein, 445 aa, Unknown
  Obtained from an environmental sample.
  SIGNAL (1)...(23)
MKRIGLLFMALALTAFMAQHSSAQRICNNQTGTHGGFYYTWWSDGGGSACITMGDGGNYSTQWSNTGNFVGGKGWSTGRSNRVISYNAGNWSPSGNAYLCLYGWTTNPLVEYYVVDSWGSWRPPGATSQGTVNTDGGTYEIYRTQRVNQPSIQGNTTFYQYWSVRTSKRATGSNATITFQNHVNAWASRGWNLGAHSYQVLATEGYQSSGSSNITVWEGGSSGGSSGGSTGGSTGGGSHEIIVRARGVVGSEQIRLRVGNTTVATWTLTTGYRDYRATTSATGGILVEYFNDSGNRDVQIDYIRVNGSTRQSENMSYNTGVWQNGSCGGSNSEWLHCNGAIGYGDVVTGRSTAVEEAFTAAEDCGCEPKATLFPNPAGSTLSIMLDRQPYGDVSIRIYNTVGAVVRTINNPDLLTEVDVSALNSGIYFVELRSEGHVSNYKFIKK

SEQ ID NO: 369 - DNA, 1077 bp, Unknown
  Obtained from an environmental sample.
atgaaatcatttatcactggcaaaaaaattgctgctggactaattactgcagctgctttgagcgcatctatggtgagcgcgcaaaccctgacttcaaattctcaaggcacccacgacggatttttctactctttctggaaggactcaggcaacgcctcaatgaacttattggcgggcggccgttatcagtctagctggaacaccggcaccaacaactgggtaggcggtaaaggctggaacccaggcactaacaaccgtgtaattaactactctggttactacggtgtggacaactcccaaaactcttacgtcgcgctttacggctggaccagaaacccattggttgagtactacgtgattgagagctacggctcatacaaccctgctagctgctctggcggcaccgatttcggtagcttccaaagtgacggcgccacctacaacgtgcgtcgttgccagcgcgtgcaacagccttcgatcgatggcacccagactttctaccaatacttcagcgtgagaaatccgaaaaaagggtttgggaacatttctggcaccatcacctttgctaaccacgtaaactactggagaagcagagggatgaatcttggtaaccacgattaccaagttctcgctactgaaggctacagaagcacgggttcttctgacctcaccatcagccaaggcgcaagcaacaacggcggtggcggcagtagctcaagtgctccatctgctgggggcggtagcaagacaatcgtcgtgcgggcacgcgggactaccggacaagagcaaatccgtttgcgggtgaacaacactattgttcagacctggaccttgtccaccaccatgcgcgactacaccgtcaacactaacttggcaggcgggtcattggttgaatacttcaatgacagcggcaaccgcgacgtccaagttgattacatcagcgtaaatggcaatgttcgccaatccgaaaaccaaacctacaacaccggtgtctaccagaacggtgcgtgtggcggcggtaacggccggagcgagtggctccattgcaacggtgcaatcgggtacggcgatatctaa

SEQ ID NO: 370 - protein, 358 aa, Unknown
  Obtained from an environmental sample.
  SIGNAL (1)...(27)
MKSFITGKKIAAGLITAAALSASMVSAQTLTSNSQGTHDGFFYSFWKDSGNASMNLLAGGRYQSSWNTGTNNWVGGKGWNPGTNNRVINYSGYYGVDNSQNSYVALYGWTRNPLVEYYVIESYGSYNPASCSGGTDFGSFQSDGATYNVRRCQRVQQPSIDGTQTFYQYFSVRNPKKGFGNISGTITFANHVNYWRSRGMNLGNHDYQVLATEGYRSTGSSDLTISQGASNNGGGGSSSSAPSAGGGSKTIVVRARGTTGQEQIRLRVNNTIVQTWTLSTTMRDYTVNTNLAGGSLVEYFNDSGNRDVQVDYISVNGNVRQSENQTYNTGVYQNGACGGGNGRSEWLHCNGAIGYGDI

SEQ ID NO: 371 - DNA, 1245 bp, Unknown
  Obtained from an environmental sample.
gtgaccgggatcgcgagaaaaggcgtatggtccgtgatttccggaactttcactgccggggattacgattcctacctgctgtatgtcgaaacacaggaccagggcggcggacacccgacgctgagctttgaaatccggaacttcagactgacggcaccggaaggcatcgctccgccgaaggcgacagaagaaccggctgacgcggcagaggcgacgcctgttccggcactgagcgagattccgggcctgaaggacgtctacgcggactactttgacttcggcgctgcggcgccgcagtatgcattcggcctcggccagacccagctgcaggacctgatgatcagccagttcagcatcctgacccctgaaaacgaactgaaaccggacagcgtgcttgatgtccagacgagtaaaaaactggcggcagaagacgaaaccgcggtggcgatcaggctgaacgccgcaacgccgctgctgaagttcgcgcagaagaacggcatcaaagtgcacggccatgtgctggtatggcacagccagacgccggaagctttcttccatgaaggatacgataccaagaaaccctatgtgacgagagaggttatgctcggccgcctggaaaactatatccgtgaagtgctgacgcagacagaggaacagttcccgggcgtgatcgtcagctgggacgtcgtgaacgaggcgatcgacgacggtactcactggctgcggaagacttccagctggtacaaagtcgtcggcgaggatttcctgaacagggcttttgaatacgccaggaaatacgccgcggagggcgtgctgctgtactacaacgattacagcacggcaaattcggctaaactgatgggcatcacgaagctgctgaagcagctgattccagacgggaatatcgacggctacggattccagatgcaccatgacctcggctggccgagcatcgaccttatggcggcagctgtgaagcagattgccggcctggggctgaaactgcgcgtcagcgaactggatatcggcgtatccaagaacaatcaggaaaactatgacaaacaggccaaacgctacaaggaaatgctgaacctgatgctgcagtacgcggaccagacggaagccgtgcaggtctggggcctgacggacaacatgagctggagaaccggcaaatacccgctgctgttcgacagcgcggcaaaaccgaaaaaggcgttcttcgcggtgattgaagccgcagaggaa

SEQ ID NO: 372 - protein, 415 aa, Unknown
  Obtained from an environmental sample.
MTGIARKGVWSVISGTFTAGDYDSYLLYVETQDQGGGHPTLSFEIRNFRLTAPEGIAPPKATEEPADAAEATPVPALSEIPGLKDVYADYFDFGAAAPQYAFGLGQTQLQDLMISQFSILTPENELKPDSVLDVQTSKKLAAEDETAVAIRLNAATPLLKFAQKNGIKVHGHVLVWHSQTPEAFFHEGYDTKKPYVTREVMLGRLENYIREVLTQTEEQFPGVIVSWDVVNEAIDDGTHWLRKTSSWYKVVGEDFLNRAFEYARKYAAEGVLLYYNDYSTANSAKLMGITKLLKQLIPDGNIDGYGFQMHHDLGWPSIDLMAAAVKQIAGLGLKLRVSELDIGVSKNNQENYDKQAKRYKEMLNLMLQYADQTEAVQVWGLTDNMSWRTGKYPLLFDSAAKPKKAFFAVIEAAEE

SEQ ID NO: 373 - DNA, 1539 bp, Unknown
  Obtained from an environmental sample.
ttgattggctgcgtcatgtcgccgccggaagcgggaagtccccgttttgatcttttaacccggcactttaatgtcatcaccgcggaaaacgccatgaagcccgcgtcgttgcagcgcgaaaagggggtgtttacttttgaacaggcggacatgatggtggacgcggtattggagcggggactgaagatccacggacatactctggcctggcaccagcagtctccggagtggatgaatcatgaggggatttcccgggacgaagccgtggaaaatctcaccgtccacgccaaaaccgcggccgctcattttagggggcgggtcatatcctgggatgtactcaacgaggcgatcattgacaatccccccaaccccggggattggcgggcatccctcaggcaaagcccctggtacaaagccataggcccggattacgtggagcttgtgttcaaggcggccagggaggcggacccggaggcaaaactttattataacgattacaaccttgataaccggaacaaggccctggcggtttacaacatggtcagggaactgaacgaaaagaatccgaatccgggcggcaggcccctcatcgacggcgtgggcatgcagggccattaccgcctgaataccaataccgataacgtgaggctgtcgctggaacggtttatttccctgggggtcgaggtcagcatcacggagctcgatatacaggccggttcggattcaaaccagacagagcggcagcgggtggaacagggcctggtctatgccgctttgtttaccattttccgggaacacgcggcaaacataggccgggtaactttttggggacttgacgacggggcaagctggcgttccgcggcgagtccctgcctctttgataaaaacctcaacgcaaaacctgccttttacgcggtcctggacccggattcctttattgcggaaaacagcgccctgctgatcagggaagcgaaagagggagaggcttattatggtacgcctgctttaggcgccgtccctgatcccctctgggacagggcgccttccctcccggtggatcagtacctcatggcctggcagggcgcttcgggaagggcaaaagtcctctgggacgaaaaaaatctctatgtgctggtccgggttgaaaacgcggaaataaacaaggacagttccaacagctacgaacaggattcggtcgaaatttttattgatgaggataaccggaaaagttcctttttcagggaggatgacgggcagtaccgggtcaattttgccaacgaggcgggctttaacccctcgtccgccggggcggggtttgtttcggccgccgcggtggatggaaaatcctataccgttaccatgaagattccctttaaaacaatagtccccggagcggggacgcgtatcgggtttgatgtccagatcaacggcgcgtcggccagggggatacgggagagcgtggcggtatggaatgataccacgggcaattcatttcaggatacctcaggttacggggtactgcggttagtaaaaaagtaa

SEQ ID NO: 374 - protein, 512 aa, Unknown
  Obtained from an environmental sample.
MIGCVMSPPEAGSPRFDLLTRHFNVITAENAMKPASLQREKGVFTFEQADMMVDAVLERGLKIHGHTLAWHQQSPEWMNHEGISRDEAVENLTVHAKTAAAHFRGRVISWDVLNEAIIDNPPNPGDWRASLRQSPWYKAIGPDYVELVFKAAREADPEAKLYYNDYNLDNRNKALAVYNMVRELNEKNPNPGGRPLIDGVGMQGHYRLNTNTDNVRLSLERFISLGVEVSITELDIQAGSDSNQTERQRVEQGLVYAALFTIFREHAANIGRVTFWGLDDGASWRSAASPCLFDKNLNAKPAFYAVLDPDSFIAENSALLIREAKEGEAYYGTPALGAVPDPLWDRAPSLPVDQYLMAWQGASGRAKVLWDEKNLYVLVRVENAEINKDSSNSYEQDSVEIFIDEDNRKSSFFREDDGQYRVNFANEAGFNPSSAGAGFVSAAAVDGKSYTVTMKIPFKTIVPGAGTRIGFDVQINGASARGIRESVAVWNDTTGNSFQDTSGYGVLRLVKK

SEQ ID NO: 375 - DNA, 570 bp, Artificial Sequence
  Synthetically generated polynucleotide
atggcccttatggcttcgacattctactggcacttgtggactgatggtatagggacagtaaatgctaccaatggatctgatggcaattacagcgtttcatggtcaaattgcgggaattttgttgttggtaaaggctggactaccggatcagcaactagggtaataaactataatgcccacgccttttcggtagtgggtaatgcttatttggctctttatgggtggacgagaaattcactcatagaatattacgtcgttgatagctgggggacttatagacctactggaacttataaaggcactgtgactagtgatggagggacttatgacatatacacgactacacgaaccaacgcaccttccattgacggcaataatacaactttcacccagttctggagtgttaggcagtcgaagagaccgattggtaccaacaataccatcacctttagcaaccatgttaacgcctggaagagtaaaggaatgaatttggggagtagttggtcttatcaggtattagcaacagagggctatcaaagtagtgggtactctaacgtaacggtctggtaa

SEQ ID NO: 376 - protein, 189 aa, Artificial Sequence
  Synthetically generated polypeptide
MALMASTFYWHLWTDGIGTVNATNGSDGNYSVSWSNCGNFVVGKGWTTGSATRVINYNAHAFSVVGNAYLALYGWTRNSLIEYYVVDSWGTYRPTGTYKGTVTSDGGTYDIYTTTRTNAPSIDGNNTTFTQFWSVRQSKRPIGTNNTITFSNHVNAWKSKGMNLGSSWSYQVLATEGYQSSGYSNVTVW

SEQ ID NO: 377 - DNA, 570 bp, Artificial Sequence
  Synthetically generated polynucleotide
atggcccttatggcttcgacattctactggcacttgtggactgatggtatagggacagtaaatgctaccaatggatctgatggcaattacagcgtttcatggtcaaattgcgggaattttgttgttggtaaaggctggactaccggatcagcaactagggtaataaactataatgcccacgccttttcggtagtgggtaatgcttatttggctctttatgggtggacgagaaatccactcatagaatattacgtcgttgatagctgggggacttatagacctactggaacttataaaggcactgtgactagtgatggagggacttatgacatatacacgactacacgaaccaacgcaccttccattgacggcaataatacaactttcacccagttctggagtgttaggcagtcgaagagaccgattggtaccaacaataccatcacctttagcaaccatgttaacgcctggaagagtaaaggaatgaatttggggagtagttggtcttatcaggtattagcaacagagggctatcaaagtagtgggtactctaacgtaacggtctggtaa

SEQ ID NO: 378 - protein, 189 aa, Artificial Sequence
  Synthetically generated polypeptide
MALMASTFYWHLWTDGIGTVNATNGSDGNYSVSWSNCGNFVVGKGWTTGSATRVINYNAHAFSVVGNAYLALYGWTRNPLIEYYVVDSWGTYRPTGTYKGTVTSDGGTYDIYTTTRTNAPSIDGNNTTFTQFWSVRQSKRPIGTNNTITFSNHVNAWKSKGMNLGSSWSYQVLATEGYQSSGYSNVTVW

SEQ ID NO: 379 - DNA, 570 bp, Artificial Sequence
  Synthetically generated polynucleotide.
atggcccttatggcttcgacattctactggcacaattggactgatggtatagggacagtaaatgctaccaatggatctgatggcaattacagcgtttcatggtcaaattgcgggaattttgttgttggtaaaggctggactaccggatcagcaactagggtaataaactataatgcccacgccttttcgccggtgggtaatgcttatttggctctttatgggtggacgagaaattcactcatagaatattacgtcgttgatagctgggggacttatagacctactggaacttataaaggcactgtgactagtgatggagggacttatgacatatacacgactacacgaaccaacgcaccttccattgacggcaataatacaactttcacccagttctggagtgttaggcagtcgaagagaccgattggtaccaacaataccatcacctttagcaaccatgttaacgcctggaagagtaaaggaatgaatttggggagtagttggtcttatcaggtattagcaacagagggctatcaaagtagtgggtactctaacgtaacggtctggtaa

SEQ ID NO: 380 - protein, 189 aa, Artificial Sequence
  Synthetically generated polypeptide.
MALMASTFYWHNWTDGIGTVNATNGSDGNYSVSWSNCGNFVVGKGWTTGSATRVINYNAHAFSPVGNAYLALYGWTRNSLIEYYVVDSWGTYRPTGTYKGTVTSDGGTYDIYTTTRTNAPSIDGNNTTFTQFWSVRQSKRPIGTNNTITFSNHVNAWKSKGMNLGSSWSYQVLATEGYQSSGYSNVTVW

What is claimed is:

1. A method for making a composition, comprising
(i) (a) providing a carrier;
(b) providing a polypeptide having a xylanase activity, and
(c) combining the carrier of (a) with the polypeptide (b);
wherein the polypeptide having a xylanase activity has at least 90% sequence identity to SEQ ID NO:160, or an enzymatically active fragment thereof; or
(ii) the method of (i), wherein the sequence comparison algorithm is a BLAST version 2.2.2 algorithm where a filtering setting is set to blastall -p blastp -d "nr pataa" -F F, and all other options are set to default.

2. A method for making a composition, comprising
(a) providing a carrier appropriate for temperatures of at least 80° C.;
(b) providing a polypeptide having a xylanase activity that is active under high temperature of at least 80° C. and having at least 90% sequence identity to SEQ ID NO:160; and
(c) combining the carrier of (a) with the polypeptide of (b), thereby producing the composition.

3. The method of claim 1, wherein the polypeptide having a xylanase activity retains activity under conditions comprising a temperature of at least 80° C.

4. The method of claim 1, wherein the polypeptide having xylanase activity, comprises an amino acid sequence having at least sequence identity to the amino acid sequence of SEQ ID NO:160.

5. The method of claim 1, wherein the method for making a composition comprises providing a carrier appropriate for making a composition for treating a wood, a wood product, a wood pulp, a Kraft pulp, a paper, a paper product, a paper pulp, or a combination thereof.

6. A method for making a composition comprising
(a) providing a carrier;
(b) providing a polypeptide having a xylanase activity, and
(c) combining the carrier of (a) with the polypeptide of (b);
wherein the polypeptide is encoded by a nucleic acid having a sequence that hybridizes under stringent conditions to a nucleic acid comprising the sequence of SEQ ID NO:159, wherein the stringent conditions comprise a wash step comprising a wash in 0.2×SSC at a temperature of about 65° C. for about 15 minutes.

7. The method of claim 3, wherein the polypeptide having a xylanase activity has at least 94% sequence identity to SEQ ID NO:160.

8. The method of claim 7, wherein the polypeptide having a xylanase activity has at least 96% sequence identity to SEQ ID NO:160.

9. The method of claim 8, wherein the polypeptide having a xylanase activity has at least about 98% sequence identity to SEQ ID NO:160.

10. The method of claim 9, wherein the polypeptide having a xylanase activity has 100% (complete) sequence identity to SEQ ID NO:160.

11. The method of claim 6, wherein the polypeptide having a xylanase activity has at least 94% sequence identity to SEQ ID NO:160.

12. The method of claim 11, wherein the polypeptide having a xylanase activity has at least 96% sequence identity to SEQ ID NO:160.

13. The method of claim 12, wherein the polypeptide having a xylanase activity has at least 98% sequence identity to SEQ ID NO:160.

14. The method of claim 13, wherein the polypeptide having a xylanase activity has 100% (complete) sequence identity to SEQ ID NO:160.

15. The method of claim 1, wherein the polypeptide lacks an endogenous signal sequence and/or carbohydrate binding module.

16. The method of claim 1, wherein the polypeptide further comprises a heterologous polypeptide sequence.

17. The method of claim 1, wherein the polypeptide lacks an endogenous signal sequence and further comprises a heterologous signal sequence.

18. The method of claim 16, wherein the heterologous sequence comprises a heterologous signal sequence, a carbohydrate binding module, a catalytic domain (CD), or a combination thereof.

19. The method of claim 18, wherein the heterologous signal sequence, carbohydrate binding module or catalytic domain (CD) is derived from a xylanase or a non-xylanase enzyme.

20. The method of claim 1, wherein the xylanase activity comprises catalyzing hydrolysis of internal $\beta$-1,4-xylosidic linkages.

21. The method of claim 1, wherein the xylanase activity comprises hydrolyzing a xylan, an arabinoxylan or a water soluble arabinoxylan to produce xylose and/or a smaller molecular weight xylo-oligomer.

22. The method of claim 1, wherein the xylanase activity comprises hydrolyzing a xylan, an arabinoxylan or a water soluble arabinoxylan in a dough or a bread product.

23. The method of claim 1, wherein the xylanase activity comprises hydrolyzing hemicelluloses.

24. The method of claim 23, wherein the xylanase activity comprises hydrolyzing hemicelluloses in a wood, a wood product, a wood pulp, a Kraft pulp, a paper pulp, a paper, a paper product, or a combination thereof.

25. The method of claim 1, wherein the xylanase activity comprises catalyzing hydrolysis of xylans in a feed or a food product, or a food, feed or nutritional supplement.

26. The method of claim 1, wherein the xylanase activity comprises catalyzing hydrolysis of xylans in a cereal-based animal food or feed, a wort or a beer, a milk or a milk product, a fruit or a vegetable.

27. The method of claim 1, wherein the xylanase activity comprises catalyzing hydrolysis of xylans in a microbial cell or a plant cell.

* * * * *

UNITED STATES PATENT AND TRADEMARK OFFICE
CERTIFICATE OF CORRECTION

PATENT NO. : 7,547,534 B2  Page 1 of 1
APPLICATION NO. : 10/517939
DATED : June 16, 2009
INVENTOR(S) : Brian Steer et al.

It is certified that error appears in the above-identified patent and that said Letters Patent is hereby corrected as shown below:

In Column 161, Line 23 in Claim 1, after polypeptide insert -- of --

Signed and Sealed this

Twenty-fourth Day of November, 2009

David J. Kappos
*Director of the United States Patent and Trademark Office*

UNITED STATES PATENT AND TRADEMARK OFFICE
CERTIFICATE OF CORRECTION

PATENT NO.        : 7,547,534 B2
APPLICATION NO.   : 10/517939
DATED             : June 16, 2009
INVENTOR(S)       : Brian Steer et al.

It is certified that error appears in the above-identified patent and that said Letters Patent is hereby corrected as shown below:

In the Drawings

Sheet 6, Fig. 6A, the circle at position column 11, row Q11H, should be darkened, and should appear as follows:

| Mutant | 1 | 5 | 8 | 11,12 | 17 | 60 | 64,65 | 68 | 79 | 200 | $T_m$ (°C) |
|---|---|---|---|---|---|---|---|---|---|---|---|
| WT   | | | | | | | | | | | 61 |
| D8F  | | | | | | | | | | | 67 |
| Q11H | | | | | | | | | | | 70 |
| N12L | | | | | | | | | | | 66 |
| G17I | | | | | | | | | | | 67 |
| G60H | | | | | | | | | | | 67 |
| P64V | | | | | | | | | | | 69 |
| S65V | | | | | | | | | | | 66 |
| G68A | | | | | | | | | | | 64 |
| S79P | | | | | | | | | | | 64 |
| 9X   | | | | | | | | | | | 95 |

Signed and Sealed this
Eighth Day of April, 2014

Michelle K. Lee
*Deputy Director of the United States Patent and Trademark Office*

CERTIFICATE OF CORRECTION (continued)

U.S. Pat. No. 7,547,534 B2

Sheet 8, Fig. 8A, the circles at position column 11, row 6X-1, 6X-2, 7X-1, 7X-2, 7X-3, 7X-4, 8X-1, 8X-2, 8X-3, 8X-4, and 9X should be darkened, and should appear as follows:

| Variant | Amino Acid Sequence (1, 5, 8, 11,12, 17, 60, 64,65, 68, 79, 200) | $T_m$ (°C) |
|---|---|---|
| WT | O...OOOOOOOOOOOOOOOO...OOOOOOOOOOOOOOOOOOOO...O | 61 |
| 6X-1 | O...OOOOOO●●OOOO●OOO...●OOOO●OOO●OOOOOOOOOOO...O | 89 |
| 6X-2 | O...OOO●OO●OOOO●OOO...●OOOO●OO●OOOOOOOOOOO...O | 90 |
| 7X-1 | O...OOO●OO●OOOO●OOO...●OOOO●OO●OOOOOOOOO●O...O | 89 |
| 7X-2 | O...OOO●OO●OOOO●OOO...●OOOO●OOO●OOOOOOOOO●O...O | 91 |
| 7X-3 | O...OOO●OO●●OOOO●OOO...●OOOO●OOO●OOOOOOOOO●O...O | 89 |
| 7X-4 | O...OOO●OO●●OOOO●OOO...●OOOO●OOO●OOOOOOOOO●O...O | 91 |
| 8X-1 | O...OOOOOO●●OOOO●OOO...●OOO●●OO●OOOOOOOOO●O...O | 90 |
| 8X-2 | O...OOO●OO●●OOOO●OOO...●OOOO●OO●OOOOOOOOO●O...O | 90 |
| 8X-3 | O...OOO●OO●●OOOO●OOO...●OOO●●OOOOOOOOOOO●O...O | 93 |
| 8X-4 | O...OOO●OO●●OOOO●OOO...●OOOO●OO●OOOOOOOOOOO...O | 94 |
| 9X | O...OOO●OO●●OOOO●OOO...●OOOO●OO●OOOOOOOOO●O...O | 95 |

D8F Q11H | G17I G60H P64V | G68A S79P
N12L S65V